United States Patent
Reumerman et al.

(10) Patent No.: US 11,781,128 B2
(45) Date of Patent: Oct. 10, 2023

(54) METHODS FOR PRODUCING HYBRID POLYKETIDE SYNTHASE GENES AND POLYKETIDES

(71) Applicant: Isomerase Therapeutics Limited, Cambridge (GB)

(72) Inventors: Richard Reumerman, Cambridge (GB); Matthew Alan Gregory, Cambridge (GB); Aleksandra Maria Wlodek, Cambridge (GB); Divyang Jani, Cambridge (GB)

(73) Assignee: ISOMERASE THERAPEUTICS LIMITED, Cambridge (GB)

( * ) Notice: Subject to any disclaimer, the term of this patent is extended or adjusted under 35 U.S.C. 154(b) by 954 days.

(21) Appl. No.: 16/319,868

(22) PCT Filed: Jul. 28, 2017

(86) PCT No.: PCT/GB2017/052221
§ 371 (c)(1),
(2) Date: Jan. 23, 2019

(87) PCT Pub. No.: WO2018/020272
PCT Pub. Date: Feb. 1, 2018

(65) Prior Publication Data
US 2020/0024595 A1    Jan. 23, 2020

(30) Foreign Application Priority Data

Jul. 29, 2016 (GB) ................................ 1613130
Mar. 7, 2017 (GB) ................................ 1703657

(51) Int. Cl.
C12N 15/70 (2006.01)
C12N 15/81 (2006.01)
C12N 15/10 (2006.01)

(52) U.S. Cl.
CPC ......... *C12N 15/1055* (2013.01); *C12N 15/70* (2013.01); *C12N 15/81* (2013.01)

(58) Field of Classification Search
None
See application file for complete search history.

(56) References Cited

FOREIGN PATENT DOCUMENTS

WO    2015/004455 A2    1/2015

OTHER PUBLICATIONS

Chemler et al., Evolution of Efficient Modular Polyketide Synthases by Homologous Recombination. J. Am. Chem. Soc. 2015, 137, 10603-10609 (Jul. 31, 2015) (Year: 2015).*
Chemler et al., Evolution of Efficient Modular Polyketide Synthases by Homologous Recombination. Journal of the American Chemical Society (2015), 137: 10603-10609, and supplemental material (Year: 2015).*
PikAIII, GenBank AAC69331.1 https://www.ncbi.nlm.nih.gov/protein/AAC69331.1 [retrieved from internet May 20, 2022], (Year: 1998).*
PikAIV, GenBank AAC69331.1 https://www.ncbi.nlm.nih.gov/protein/AAC69332.1 [retrieved from internet May 20, 2022] (Year: 1998).*
EryAIII, GenBank AAV51822.1 https://www.ncbi.nlm.nih.gov/protein/AAV51822.1 [retrieved from internet May 20, 2022] (Year: 2004).*
Blast (https://blast.ncbi.nlm.nih.gov/Blast.cgi) (Year: 2022).*
Lal et al., Regulation and manipulation of the gene clusters encoding type-I PKSs. Trends in Biotechnology (2000), 18(6): 264-274 (Year: 2000).*
Brown et al., Structural, functional and evolutionary perspectives on effective re-engineering of non-ribosomal peptide synthetase assembly lines. Nat. Prod. Rep. (2018), 35: 1210-1228 (Year: 2018).*
NCBI Accession F9X9V1, RecName: Full=Nonribosomal peptide synthetase 2; AltName: Full=Ferrichrome A-like siderophore biosynthesis protein NRPS2, https://www.ncbi.nlm.nih.gov/protein/F9X9V1 [retrieved Oct. 18, 2022] (Year: 2022).*
Blast alignments https://blast.ncbi.nlm.nih.gov/Blast.cgi between Seq ID No. 37, 39, 95, DEBS3 and NPRS2 [retrieved Oct. 14, 2022] (Year: 2022).*
"In silico" Merriam-Webster Dictionary, https://www.merriam-webster.com/dictionary/in%20silico [retrieved Apr. 13, 2023] (Year: 2023).*
Kosuri and Church, Large-scale de novo DNA synthesis: technologies and applications, Nature Methods (2014), 11: 499-507 (Year: 2014).*
De Clercq, et al., "Chemical Dimerizers in Three-Hybrid Systems for Small Molecule-Target Protein Profiling" ACS Chem. Biol. (2016) 11(8):2075-90.
Martin, F., "Fifteen years of the yeast three-hybrid system: RNA-protein interactions under investigation" Methods (2012) 58(4):367-75.
Licitra, et al., "A three-hybrid system for detecting small ligand-protein receptor interactions" Proc. Natl. Acad. Sci. (1996) 93(23):12817-21.
Odell, et al., "Yeast three-hybrid screen identifies TgBRADIN/GRA24 as a negative regulator of Toxoplasma gondii bradyzoite differentiation" PLoS One (2015) 10(3):e0120331. Bashiruddin, et al., "Construction and screening of vast libraries of natural product-like macrocyclic peptides using in vitro display technologies" Curr. Opin. Chem. Biol. (2015) 24:131-138.
Hertweck, C., "Decoding and reprogramming complex polyketide assembly lines: prospects for synthetic biology" Trends Biochem Sci. (2015) 40(4):189-99.
Burioni, et al., "An improved phage display vector for antibody repertoire cloning by construction of combinatorial libraries" Res. Virol. (1997) 148(2):161-4.
Vecchio, et al., "Active-site residue, domain and module swaps in modular polyketide synthases" J. Ind. Microbiol. Biotechnol. (2003) 30(8):489-94.

(Continued)

*Primary Examiner* — Samuel C Woolwine
*Assistant Examiner* — Catherine Konopka
(74) *Attorney, Agent, or Firm* — Robert C. Netter, Jr.; Dann, Dorfman, Herrell & Skillman

(57) ABSTRACT

The present invention provides inter alia methods for generating a library of cells producing polyketides and selecting for these strains based on binding to a protein target.

24 Claims, 77 Drawing Sheets

Specification includes a Sequence Listing.

(56) References Cited

OTHER PUBLICATIONS

Dunn, et al., "Engineering the acyltransferase substrate specificity of assembly line polyketide synthases" J. R. Soc. Interface (2013) 10:20130297.

Lahlou, M., "The Success of Natural Products in Drug Discovery" Pharmacology & Pharmacy (2013) 4:17-31.

Magari, et al., "Pharmacologic control of a humanized gene therapy system implanted into nude mice" J. Clin. Invest. (1997) 100(11):2865-2872.

Parmley, et al., "Antibody-selectable filamentous fd phage vectors: affinity purification of target genes" Genes (1988) 73:305-318.

Ranganathan, et al., "Knowledge-based design of bimodular and trimodular polyketide synthases based on domain and module swaps: a route to simple statin analogues" Chemistry & Biology (1999) 6:731-741.

Rui, et al., "Engineering Biosynthesis of Non-ribosomal Peptides and Polyketides by Directed Evolution" Curr. Top. Med. Chem. (2016) 16:1-8.

Smith, G.P., "Filamentous Fusion Phage: Novel Expression Vectors That Display Cloned Antigens on the Virion Surface" Science (1985) 228:1315-1317.

Weissman, K.J., "Genetic engineering of modular PKSs: from combinatorial biosynthesis to synthetic biology" Nat. Prod. Rep. (2016) 33:203-230.

Nivina, et al., "Evolution and Diversity of Assembly-Line Polyketide Synthases" Chem. Rev. (2019) 119:12524-12547.

Wlodek, et al., "Diversity oriented biosynthesis via accelerated evolution of modular gene clusters" Nature Comm. (2017) 8:1206.

\* cited by examiner

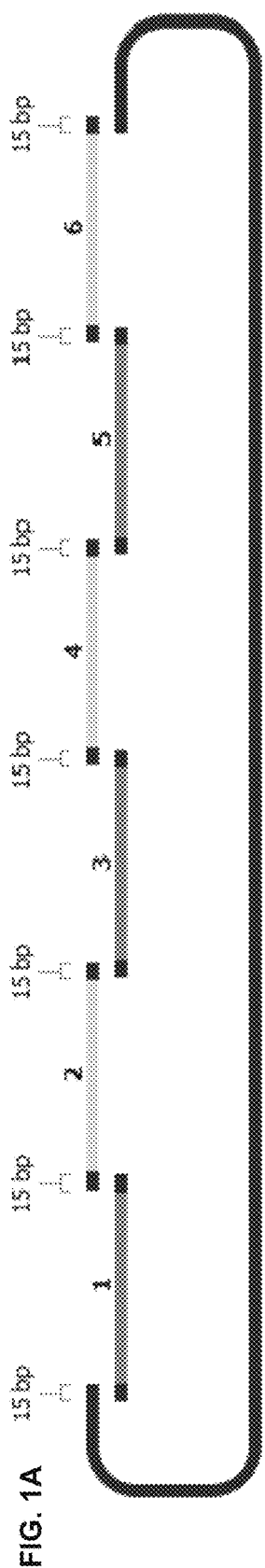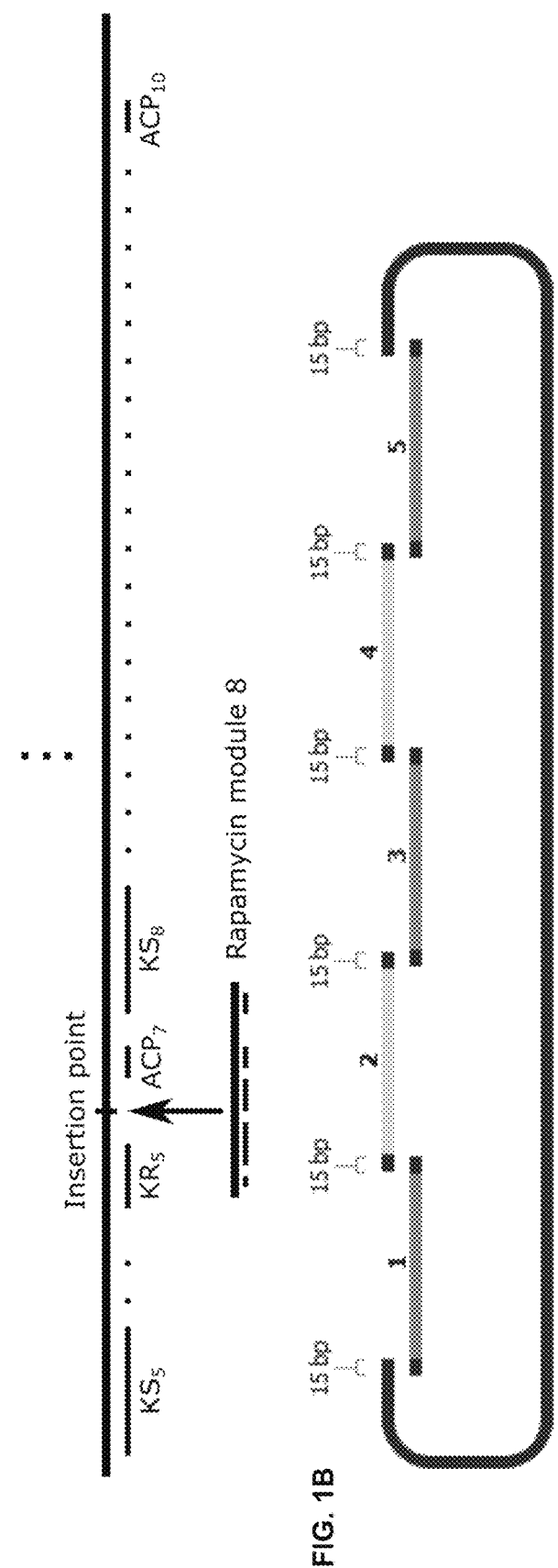

| | | |
|---|---|---|
| RapKS14 | GSLPRTLHVDAPSPHVDWTSGSVALLTEHQPWPDTKLRRAGVSSFGLSGTNAHVVLEQY | 419 |
| RapKS4  | GFVPRTLHVDEPSRHVDWAAGAVELVRENQPWPGTDRPRRAGVSSFGVSGTNAHVVLESA | 416 |
| RapKS7  | STVPRTLHVNEPSRHVDWSAGAVELVTEHQSWPVTGRPRRAGVSAFGVSGTNAHVVLESA | 416 |
| RapKS3  | NTVPRTLHVDEPSRHVDWAAGAVELVRENQPWPGTDR PRRAGVSSFGVSGTNAHVILESA | 413 |
| RapKS6  | NTVPRTLHVDEPSRHVDWAAGAVELVRENQPWPGTDRPRRAGVSSFGVSGTNAHVILESA | 417 |
| RapKS13 | NTVPRTLHVDEPSRHVDWAAGAVELVRENQPWPGTDRPRRAGVSSFGVSGTNAHVILESA | 416 |
| RapKS11 | ALVPRTLHVDEPSRHVDWTAGAVELVTENQPWPEIGRPRRAGVSSFGVSGTNAHVILESA | 418 |
| RapKS1  | GFVPRTLHVDEPSRHVDWSAGAVELVAENRSWPATGRPRRAGVSAPGVSGTNAHVILESA | 417 |
| RapKS10 | SMVPRTLHVDEPSRHVDWSAGAVELVAENQPWPETGRPRRAGVSSFGISGTNAHVILESA | 417 |
| RapKS9  | GLVPRTLHVDEPSRHVDWTDGAVELVTENQSWPEAGRPRRAGVSSFGVSGTNAHVILESA | 416 |
| RapKS5  | VLVPRTLHVDEPSRHVDWTDGAVALVTENQPWPIKGR PRRAGVSSFGISGTNAHVILESA | 417 |
| RapKS12 | GLVPRTLHVDEPSRHVDWSAGAVQLVTENQPWPDMGRARRAGVSSFGISGTNAHVILESA | 413 |
| RapKS2  | GFVPRTLHVDEPSRHVDWSAGAVQLVTENQPWPGTDRPRRAGVSSFGISGTNAHVILESA | 414 |
| RapKS8  | GFVPRTLHVDEPSRHVDWSAGAVALVTENQPWPDMGRARRAGVSSFGISGTNAHVILESA | 414 |
|         | :  *****:  *****  *  *  *:*   :       ***** *  **:***;  |     |

| | | |
|---|---|---|
| RapKS14 | - | 419 |
| RapKS4  | P | 417 |
| RapKS7  | P | 417 |
| RapKS3  | P | 414 |
| RapKS6  | P | 418 |
| RapKS13 | P | 417 |
| RapKS11 | P | 419 |
| RapKS1  | P | 418 |
| RapKS10 | P | 418 |
| RapKS9  | P | 417 |
| RapKS5  | P | 418 |
| RapKS12 | P | 414 |
| RapKS2  | - | 414 |
| RapKS8  | P | 415 |

FIG. 2D

CLUSTAL O(1.2.1) multiple sequence alignment

```
AT1    VFPPQGNQWILGMGSALPTSSMVFAERMAECAAALSEFVDWDLFAVLD------DPAVVAR  54
AT7    VFPPQGNQWILGMGSALRGSSVVFAERMAECAAALSEFVDWDLFAVLD------DPAVVDR  54
AT10   VFPPQGNQWILGMGSALRDSSVVFAERMAECAAALSEFVDWDLFAVLD------DPAVVDR  54
AT4    VFPPQGNQWILGMGSALRDSSVVFAERMAECAAALSEFVDWDLFAVLD------DPAVVDR  54
AT6    VFPPQGNQWILGMGSALRDSSVVFAERMAECAAALSEFVDWDLFAVLD------DPAVVDR  54
AT3    VFPPQGNQWILGMGSALRDSSVVFAERMAECAPALREFVDWDLFTVLD------DPAVVDR  54
AT13   VFPPQGNQWILGMGSALRDSSVVFAERMAECAAALSEFVDWDL-TVLD------DPAVVDR  53
AT14   VFPPQGNQWILGMGSALREFVDWDLFTVLD------DPAVVDR  54
AT5    LFDPQGTQRLGMGKELYDSYPAFARAWDTVSAGPDKHLDHSLTDVCFGEGGSTTAGLVDD  60
AT9    VFPPQCSQRAGMGEELAAAFPVFARIHQQVWGLLDV-----------PDLEVNE  43
AT2    VFPPQCSQRAGMGAELAAAFPVFARIHQQVWGLLDV-----------PDLEVNE  43
AT8    VFPPQCSQRAGMGEELAAAFPVFARIHQQVWDLLDV-----------PDLDVNE  43
AT11   VFPPQCSQRAGMGEELAAAFPVFARIHQQVWDLLDV-----------PDLDVNE  43
AT12   VFPPQCSQRAGMGEELAAAFPVFARIHQQVWDLLDV-----------PDLEVNE  43
                *   *              *         *              *

AT1    VDVVQPASWAVMVSLAAVWQAAGVRPDAVVGHSQGEIAAACVAGAVSLRDAARVTTLRSQ  114
AT7    VDVVQPASWAVMVSLAAVWQAAGVRPDAVIGHSQGEIAAACVAGAVSLRDAARVTTLRSQ  114
AT10   VDVVQPASWAVMVSLAAVWQAAGVRPDAVIGHSQGEIAAACVAGAVSLRDAARVTTLRSQ  114
AT4    VDVVQPASWAVMVSLAAVWQAAGVRPDAVIGHSQGEIAAACVAGAVSLRDAARVTTLRSQ  114
AT6    VDVVQPASWAVMVSLAAVWQAAGVRPDAVIGHSQGEIAAACVAGAVSLRDAARVTTLRSQ  114
AT3    VDVVQPASWRMMVSLAAVWQAAGVRPDAVIGHSQGEIAAACVAGAVSMRDAARVTTLRSE  114
AT13   VDVVQPASWAMMVSLAAVWQAAGVRPDAVIGHSQGEIAAACVAGAVSLRDAARVTTLRSE  113
AT14   VDVVQPASWAVMVSLAAVWQAAGVRPDAVIGHSQGEIAAACVAGAVSLRDAARVTTLRSQ  114
AT5    TLYAQGIFAMEAALFGLLEDWGLLEDWGVRPDFVAGHSIGEATAAYASGMLSLENVTTLIVARGR  120
AT9    TGYAQPALFALQVALFGLLESWGELAAGYVSGELAAGYVSGLWSLEDACTLVSAPAR  103
AT2    TGYAQPALFALQVALFGLLESWGELAAGYVSGELAAGYVSGLWSLEDACTLVSAPAR  103
AT8    TGYAQPALFALQVALFGLLESWGELAAAYVSGELAAAYVSGLWSLEDACTLVSARAR  103
AT11   TGYAQPALFALQVALFGLLESWGELAAAYVSGELAAAYVSGLWSLEDACTLVSAPAR  103
AT12   TGYAQPALFAMQVALFGLLESWGELAAAYVSGELAAAYVSGLWSLEDACTLVSARAR  103
                           ****                            *     *
```

```
AT1   AEYWYRNLREPVGFEPAAGQLQAQGDTVFVEVSASPVLLQAMDDV--------------------  273
AT7   VEYWYRNLREPVGFDSAVGQLRAEGDTVFVEVSASPVLLQAMDDV--------------------  273
AT10  GEYWYRNLREPVGFHPAVSQLQAQGDTVFVEVSASPVLMQAMDDV--------------------  272
AT4   GEYWYRNLREPVGFHPAVSQLQAQGDAVFVEVSASPVLLQAMDDV--------------------  273
AT6   VEYWYRNLREPVGFHPAVGQLQAEGDTVFVEVSASPVLLQAMDDV--------------------  273
AT3   GEYWYRNLREPVGFHPAVGQLQAQGDTVFVEVSASPVLLQAMDDV--------------------  272
AT13  GEYWYRNLREPVGFHPAVSQLQAQGDTVFVEVSASPVLLQAMDDV--------------------  273
AT14  PEYWLRQVRRPVRFQDAVRELAEQGVGTFVEVGPSGALAS--AGVECLGGDASFHA          292
AT5   AEYWVRQVRDTVRFGEQVASYED----AVFIELGADRSLARLVIGVAMLHTDH--          256
AT9   AEYWVRQVRDTVRFGEQVASYED----AVFVELGADRSLARLVIGVAMLHGD--           255
AT2   AEYWVRQVRDTVRFGEQVASFED----AVFVELGADRSLARLVIGIAMLHGDHEAQA        260
AT8   TEYWVRQVRDTVRFGEQVASYED----AVFVELGADRSLARLVIGTAMLHGDHEAQA        260
AT11  AEYWVRQVRDTVRFGEQVASYED----AVFVELGADRSLARLVIGVAMLHGDH--          256
AT12  AEYWVRQVRDTVRFGEQVASYED----AVFVELGADRSLARLVIGVAMLHGD--           255
       ***  *::: *   *    *      *  ***:  *:*  ::  *
```

FIG. 3C

```
CLUSTAL O(1.2.1) multiple sequence alignment

KR-ACP13      GTVLITGGSGVLAGILABHLAAEHGARHLLLLSRTTPDQALIKELAELGAH-VDTATCDV   59
KR-ACP6       GTVLITGGSGVLAGALAARHLVTERGVRHLLLLSRTTADEGLLNELGELGAR-VETADCDV  59
KR-ACP3       GTILITGGSGVLAGILARHLAAEHGARHLLLLSRTAPDEALIKELAELGAR-VETAACDV   59
KR-ACP5       GTVLITGGSGVLAGIVARHLVAERGVRHLLLLSRGTPDRALLSELAELGAR-VDTAACDV   59
KR-ACP10      GTVLITGGSGVLAGIAARHLVAERGVRHLLLLSRSAPDEALISELAELGAAVVDTAVCDV   60
KR-ACP8       GTVLITGGSGVLAGILARHLAAEHGARHLLLLSRTTPDQALISELGELGAQ-VATAVCDV   59
KR-ACP1       GTVLITGGSGVLAGIAARHLVAEHGARHLLLLSRTTPDQALIKELAELGAR-VDTATCDV   59
KR-ACP7       GTVLVTGGSGVLAGIAARHLVAEDGVRHLLLLSRSTPDDALINELGELGAR-VDTATCDV   59
KR-ACP12      GTVLITGGSGVLAGIAARHLVTERGVRHLLLLSRSAPDEALINQLGELGAR-VETAACDV   59
KR-ACP2       GTVLITGGSGVLAGIAARHLVAERGVRHLLLLSRSAPDEALIGELGELGAR-VETAACDV   59
KR-ACP11      GTVLITGGSGVLAGIAARHLVAERGVRHLLLLSRSAPDEALINQLGELGAR-VETAACDV   59
KR-ACP4       GTVLITGGSGVLAGIAARHLVARRGVRHLLLLSRSAPDEALINQLGELGAR-VETAACDV   59
KR-ACP9       GTVLITGGSGVLAGIAVRHLVAERGVRHLLLLSRSAPDEALINQLGELGAR-VETAACDV   59
              **:*:********* .:**.:***:.*******.:**:*  :*.:***  .:**: ***

KR-ACP13      SDRAGLARVLAGVSPEHPLTAVIHTAGALDDGVVESLTTQQLDTVLRPKADGAWNLHELT  119
KR-ACP6       SDRAGLARVLAGVSPEHPLTAVIHTAGALDQACALDDGVLETLTTAQRLDTVLTAQRLDT 119
KR-ACP3       SDRAGLARVLAGVSPEHPLTAVIHTAGALDDGVVESLTTQQLDTVLRPKADGAWHLHELT  119
KR-ACP5       SDRAGLARVLAGVSPEHPLTAVIHTAGALDDGVVDDGVVESLTTAQRLDTVLRPKADGAWHLHELT 119
KR-ACP10      SDRPGLVRVLADVSPDHPLTAVIHTAGVLDDGVVDDGVLEDLTVLRPKADGAWHLHELT    120
KR-ACP8       SDRAGLARVLAGVSPEHPLTAVIHTAGVLDDGVVESLTARRLDTVLRPKADGAWHLHELT  119
KR-ACP1       SDRPGLVRVLADVSPDHPLTAVIHTAGVLDDGVVESLTTAQRLDTVLRPKADGAWHLHELT 119
KR-ACP7       SDRAGLARTLAGVSPEHPLTAVIHTAGALDDGVVESLTTAQQLETVLRPKADGAWHLHELT 119
KR-ACP12      SDPAATTQVLAGVSPEHPLTAVIHTAGVLDDGVVESLTTAQRLDTVLRPKADGAWHLHELT 119
KR-ACP2       SDRAALTQVLAGVSPEHPLTAVIHTAGVLDDGVVESLTVQRLDTVLRPKADGAWHLHELT  119
KR-ACP11      SDPAALTQVLAGVSPEHPLTAVIHTAGVLDDGVVESLTVQRLDTVLRPKADGAWHLHELT  119
KR-ACP4       SDPAALAQVLAGVSPEHPLTAVIHTAGALDDGVVESLTAQRLDAVLRPKADGAWHLHELT  119
KR-ACP9       SDPAALAQVLAGVSPEHPLTAVIHTAGVLDDGVVESLTAQRLDAVLRPKADGAWHLHELT  119
              **  .: :.**..**::*********.:*:*** .:.:  :: ::**:************
```

```
KR-ACP13  GLQTVRPQSRTAARNEVGSQPLSARLTGRTSVEQHRIMLELVL-ERRSVLGHSSADAIA  298
KR-ACP6   SLR----RPVARRAASAD-GGVQW----LAALAPAEREKA LKVVCDSAAVVLGHADARTIP  277
KR-ACP3   SLR----RPTARRAASAD-GGVQW----LAALAPAEREKA LKLVCDSAAMVLGHADARSIP  291
KR-ACP5   SLH----RPNVRRAALAGG--AQW----LAALAPAEREKA LKVVRDTAATVLGHADARTIP  290
KR-ACP10  LLH----RPVARRAASTGDSSAQW----LVGLAPEERAKA LKVVRDSAATVLGHADARSIP  293
KR-ACP8   SLH----RPVARRAASGGA--VRC----LAALAPEERAKA VKVVCDSAATVLGHADVDSIP  290
KR-ACP1   LLH----RPVARRAASTGDSSVQW----LARLAPVEREKA LKLVCDGAATVLGHADASTIP  292
KR-ACP7   LLH----RPVARRAASTGGSSVQW----LARLAPVEPEKA LKVVCUGAATVLGHADASTIP  292
KR-ACP12  SLH----RPVARRAASTDSSARW----LAALAPAEREDA LKLIVRDSAALVLGHADASTIP  292
KR-ACP2   SLH----RPTARRAAAGG---ARW----LAALAPAEREKA LKLIVCDSAATVLGHADTSTIP  290
KR-ACP14  SLH----RPTARRAAAGG---ARW----LAALAPEERAKA LKLVSDGAATVLGHADTSTVS  290
KR-ACP4   SLH----RPTARRAASTGDSSVQW----LAALAPAEREKA LRVVCDSAATVLGHADIDSIP  292
KR-ACP9   SLH----RPVARRAAAAG--GARN----LAALAPAEREKA LKLVSDGAATVLGHADTSTIP  290
                **      *                ***      *****:   *:

KR-ACP13  TDTSFKDLGMDSLITAIELRNLVAETGLQLPATMVFDYPTANALAAHLLGK  349
KR-ACP6   VTGAFKDLGVDSLTAVELRNSLVKATGLRLPATMVFDYPTPTLAARLDE-  327
KR-ACP3   AAGAFKDLGVDSLMAVELRNGLVKATGLRLPATLVFDYPTPTVLAARLDE-  341
KR-ACP5   VTGAFKDLGIDSLTAVELRNGLAKVTGLRLPATLVFDYPTPAVLAARLGE-  340
KR-ACP10  ATGAFKDLGVDSLTAVELRNSLTKATGLRLPATMVFDYPTPADLAARLGD-  343
KR-ACP8   ATGAFKDLGVDSLTAVELRNSLTKATGLRLPATLVFDYPTPGALAARLEE-  340
KR-ACP1   ATAAFKDLGVDSLTAVELRNGLAKATGLRLPATLVFDYPTPAALAARLEE-  342
KR-ACP7   ATAAFKDLGIDSLTAVELRNSLTKATGLRLPATLVFDYPTPAALAARLG--  341
KR-ACP12  AAAAFKDLGIDSLTAVELRNSLAKATGLRLPNTTVFDYPTPAILATRLGE-  342
KR-ACP2   VAAVFRDLGVDSLTAVDLRNSLAKATGLRLPATLVFDYPTPAALAARLG--  339
KR-ACP14  ATTAFKDLGINSLTAVELRNSLAKATELRLPATLVFDYPTPAALAARLDE-  340
KR-ACP4   VTAAFKDLGVDSLTAVDLRNSLANATGLRLPPTLVFDYPTPTALAARLDE-  342
KR-ACP9   ATTAFKDLGIDSLTAVELRNSLAKATEILRLPATLVFDYPTPTALAARLDE-  340
               *:    **: *:** *  ******  *:
```

FIG. 4C

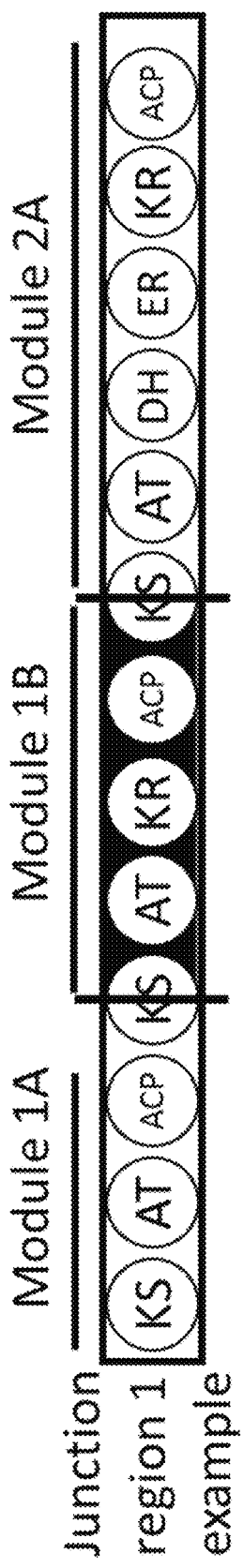
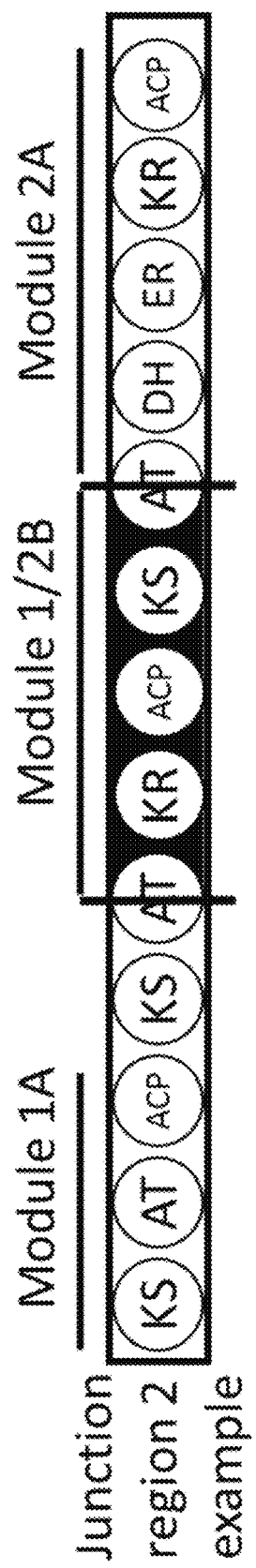
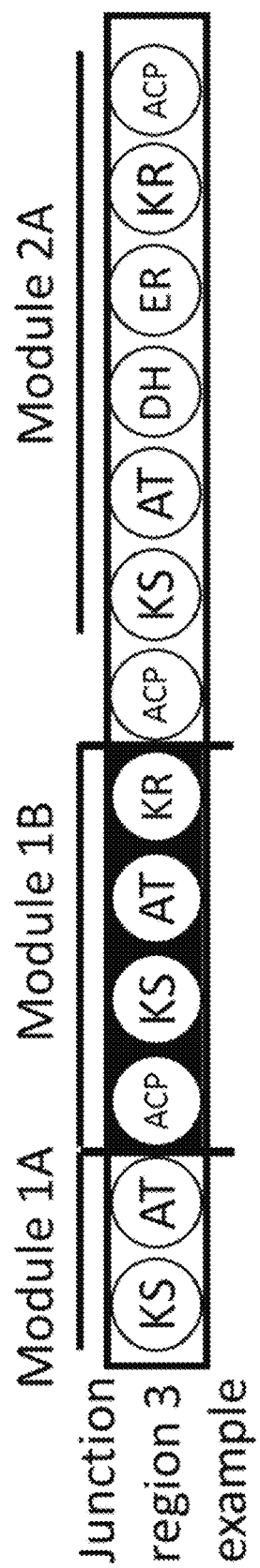
FIG. 6B

FIG. 7B

| | | |
|---|---|---|
| KS12 | cgaggtggatgtggtcgaggcacgggcacggcacacgctggtgacccgatcgaggc | 60 |
| KS6 | cgaggtggatgtggtcgaggcacgggtacgacggcacacgctgggtgacccgatcgaggc | 60 |
| KS13 | cgaggtggatgtggtcgaggcccgggcacggcacacgctgggcgacccgatcgaggc | 60 |
| KS7 | cgaggtggatgtggtcgaggcacgggtacgacggcacacgctgggtgacccgatcgaggc | 60 |
| KS8 | cgaggtggatgtggtcgaggcacgggtacgacggcacacgctgggtgacccgatcgaggc | 60 |
| | ************************ ** ****** **** ************** | |

| | | |
|---|---|---|
| KS12 | ccag | 64 |
| KS6 | ccag | 64 |
| KS13 | ccag | 64 |
| KS7 | ccag | 64 |
| KS8 | ccag | 64 |
| | **** | |

FIG. 7C

| | | |
|---|---|---|
| KS8 | cgaAgtggaCgtCgtcgagggcCacgggCacgacggcTggtgacCgaTAgaAgc | 60 |
| KS13 | cgaAgtggaCgtCgtcgagggcCcacTggcacgggcCacgacgacgctTggTgacCgaTAgaAgc | 60 |
| KS6n | cgaggtggatCgtcgtcgagtgcacgggtacgacggcacacgctggcgacccgatcgaggc | 60 |
| KS7 | cgaggtCgaTgtggtCgaggcacgggTacCgaTacTacCggtgaTccTatcgaggc | 60 |
| KS12 | tgaggtCgaTgatTgatgcggTgaAcacggTacCgaTacCggtTgaTccTatcgaggc | 60 |
| | ** * ***** ** ** *** * ***** ** ** ** * * ** * ***** | |

| | | |
|---|---|---|
| KS8 | ccaA | 64 |
| KS13 | ccaA | 64 |
| KS6n | ccag | 64 |
| KS7 | Acag | 64 |
| KS12 | Acag | 64 |
| | *** | |

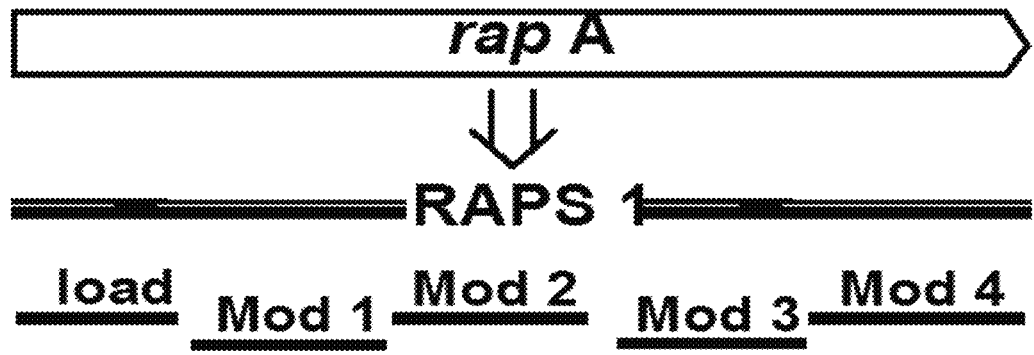
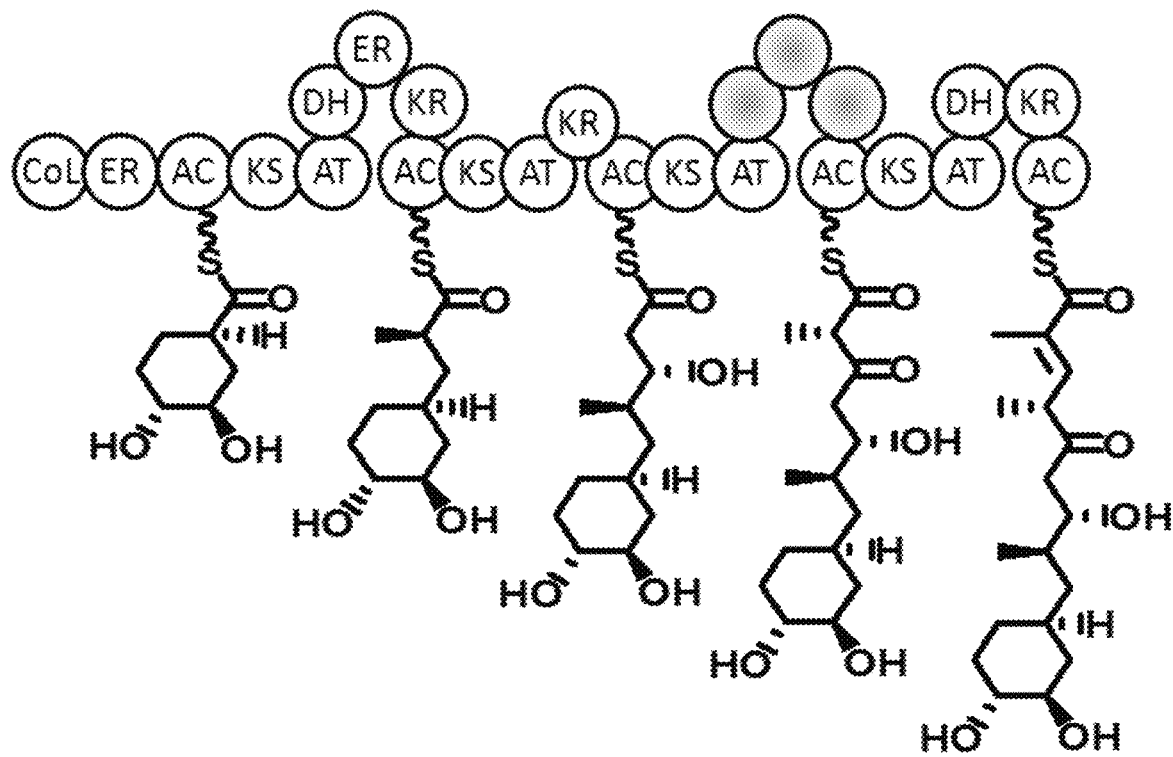
FIG. 11A

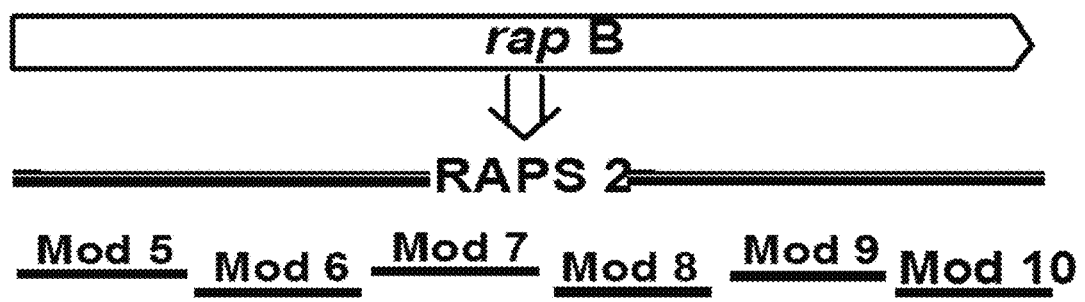
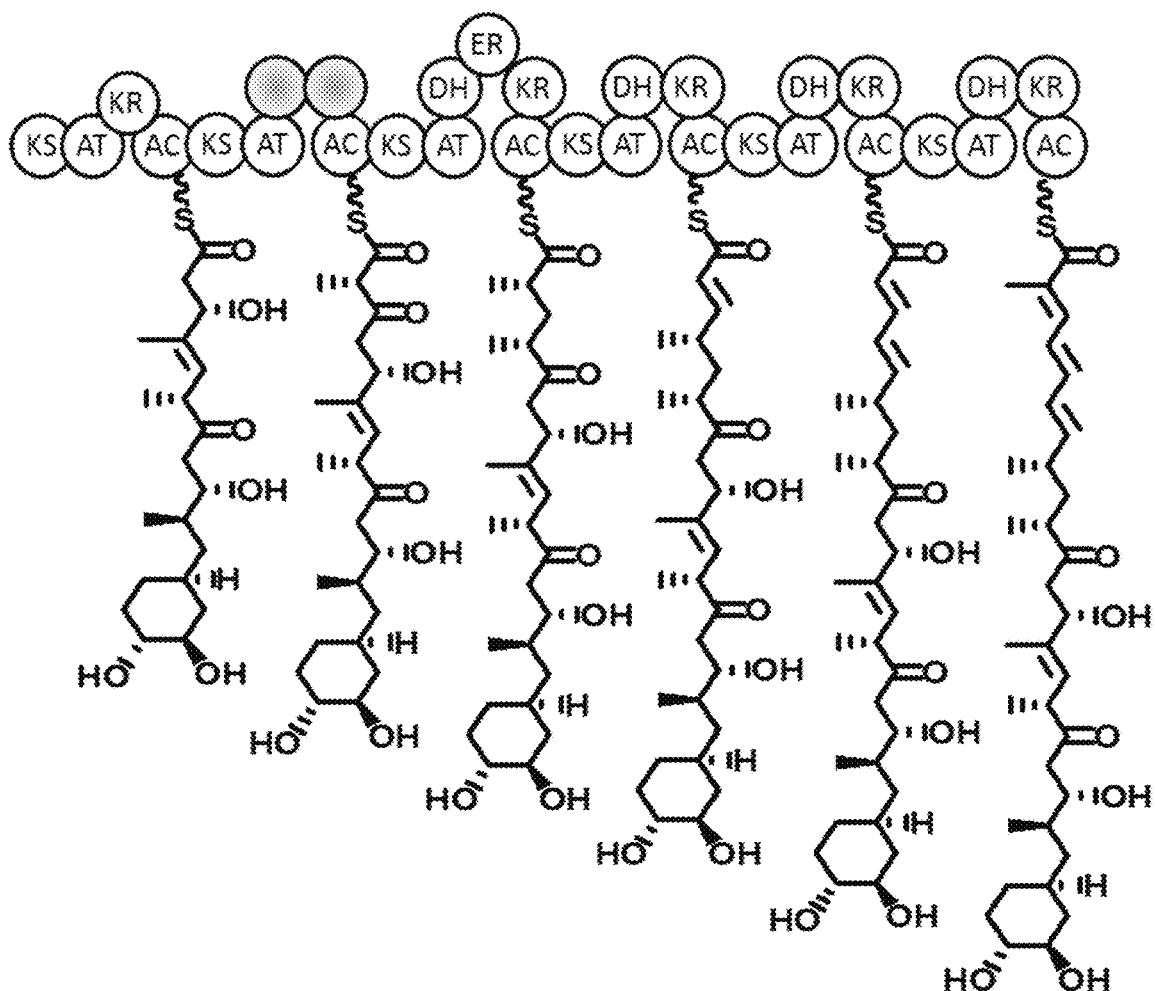
FIG. 11B

Typical organisation of a PKS module

Typical organisation of a NRPS module

| Strain no. | Arrangement of first two PKS genes | Titre of product (µM) |
|---|---|---|
| 4010 | | |
| 4309 | | 9 |
| 4141 | | 121 |
| 4280 | | 177 |
| 4291 | | 197 |

ISOM-4142

```
ISOM-4142   VVFAERMAECAAALSEFVDWDLFTVLDDPAVVDRVDVVQPASWAMMVSLAAVWQAAGVRP
Module 3    VVFAERMAECAAALSEFVDWDLFTVLDDPAVVDRVDVVQPASWAMMVSLAAVWQAAGVRP
Module 6    IVFAERMAECAAALREFVDWDLFTVLDDPAVVDRVDVVQPASWAVMVSLAAVWQAAGVRP
            ************:***************************:*****************
```

FIG. 15D

ISOM-4172

[Diagram showing 55,000 band with ACP2, KS5/6, rppA/B, AT6 modules]

```
ISOM-4172    QGECSLALVGGVTVMATPELFTEEFSRQRGLASDGRCKAFADSADGTGWAEGVGVLLVERL
Module 3     QGECSLALVGGVTVMATPELFTEEFSRQRGLASDGRCKAFADSADGTGWAEGVGVLLVERL
Module 6     QGECSLALVGGVTVMATPQSFVEFSRQRGLASDGRCKAFADSADGTGWAEGVGVLLVERL
             ***************:.:.*************************************

ISOM-4172    SDAQAKGHQVLAVVRSSAVNQDGASNGLSAPNGPSQQGVIRQALANAGLTTAEVDVVEAH
Module 3     SDAQAKGHQVLAVVRSSAVNQDGASNGLTAPNGPSQQRVTQAALSNAGLAAHEVDVVEAH
Module 6     SDAQAKGHQVLAVVRSSAVNQDGASNGLSAPNGPSQQGVIRQALANAGLTTAEVDVVEAH
             ***************************:*****:.*:**:**.***:: ********
```

FIG. 15G

ISOM-4176

```
ISOM-4176   ASWAMMVSLAAVWQAAGVRPDAVIGHSQGEIAAACVAGAVSLRDAARIVTLRSQAIARGL
Module 6    ASWAMMVSLAAVWQAAGVRPDAVIGHSQGEIAAACVAGAVSMRDAARIVTLRSQAIARGL
Module 7    ASWAVMVSLAAVWQAAGVRPDAVIGHSQGEIAAACVAGAVSLRDAARIVTLRSQAIARGL
            ****:*****************************:*************
```

FIG. 15H

ISOM-4178

```
ISOM-4178  VVFAERMAECAAALSEFVDWDLFTVLDDPAVVDPAVVDRVDVVQPASWAVMVSLAAVWQAAGVRP
Module 3   VVFAERMAECAAALSEFVDWDLFTVLDDPAVVDPAVVDRVDVVQPASWAVMVSLAAVWQAAGVRP
Module 7   VVFAERMAECAAALSEFVDWDLFAVLDDPAVVDPAVVDRVDVVQPASWAVMVSLAAVWQAAGVRP
           ****************** :*********************************** ******

ISOM-4178  DAVIGHSQGEIAAACVAGAVSLRDAARIVTIRSQAIARGLAGRGAMASVALPAHEIELVD
Module 3   DAVIGHSQGEIAAACVAGAVSLRDAARIVTIRSQAIARGLAGRGAMASVALPAQDVELVD
Module 7   DAVIGHSQGEIAAACVAGAVSLRDAARIVTIRSQAIARGLAGRGAMASVALPAHEIELVD
           ******************************************************:::***
```

FIG. 15I

ISOM-4184

| | |
|---|---|
| ISOM-4184 | VFPGQGSQRAGMGEELARAAFPVEARIHQQVWDLLDVPDLDVNETGYAQPALFALQVALFG |
| Module 2  | VFPGQGSQRAGMGEELARAAFPVEARIHQQVWDLLDVPDLDVNETGYAQPALFALQVALFG |
| Module 8  | VFPGQGSQRAGMGEELARAAFPVEARIHQQVWDLLDVPDLEVNETGYAQPALFALQVALFG |
|           | ************************************************************ |

| | |
|---|---|
| ISOM-4184 | LIESWGVRPDAVVGHSVGELAAGYVSGIMSLEDACTIVSARARIMQALFAGGVMVAVPVS |
| Module 2  | LIESWGVRPDAVVGHSVGELAAGYVSGIMSLEDACTIVSARARIMQALFAGGVMVAVPVS |
| Module 8  | LIESWGVRPDAVVGHSVGELAAGYVSGIMSLEDACTIVSARARIMQALFAGGVMVAVPVS |
|           | ************************************************************ |

| | |
|---|---|
| ISOM-4184 | BDEARAVLGEGVEIAAVNGPSSVVLSGDEAAVLQAAEGLGKWTRLATSHAFHSARMEPML |
| Module 2  | BDEARAVLGEGVEIAAVNGPSSVVLSGDEAAVLQAAEGLGKWTRLATSHAFHSARMEPML |
| Module 8  | BDEARAVLGEGVEIAAVNGPSSVVLSGDEAAVLQAAEGLGKWTRLATSHAFHSARMEPML |
|           | ************************************************************ |

| | |
|---|---|
| ISOM-4184 | EEFRTVAEGLTYRTPQVSMAAGDQVTTTEYWVRQVRDTVRFGEQVASYEDAVFVELGADR |
| Module 2  | EEFRTVAEGLTYRTPQVSMAAGDQVTTTEYWVRQVRDTVRFGEQVASFEDAVFVELGADR |
| Module 8  | EEFRTVAEGLTYRTPQVSMAAGDQVMTAEYWVRQVRDTVRFGEQVASFEDAVFVELGADR |
|           | ********************:  *:**********************:******* |

FIG. 15K

ISOM-4185

```
ISOM-4185  ERLSDAQAKGHQVLAVVRSSAVNQDGASNGLTAPNGPSQQGVIRQALANAGLTTAEVDVV
Module 3   ERLSDAQAKGHQVLAVVRSSAVNQDGASNGLTAPNGPSQQRVIQAALSNAGLAAHEVDVV
Module 6   ERLSDAQAKGHQVLAVVRSSAVNQDGASNGLSAPNGPSQQGVIRQALANAGLTTAEVDVV
           ******************************:*****:**:*****   *: ********
```

FIG. 15L

ISOM-4186

| | |
|---|---|
| | FDPAB |
| | ER77 KR7 |

```
ISOM-4187    DIALVPTDTAERPLQSGEVRVDVRAAGINFRDVVVALGMVDDKRLAGGERAGVLEVGPE
Module 1     DIALVPTDTAERPLQSGEVRVDVRAAGINFRDVVVALGMVDDKRLAGGERAAGVLEVGPE
Module 7     DIALVPAETAERPLQSGEVRVDVRAAGINFRDVLIALGTYPGEAVIGAEAAGVLEVGPE
             ****** :******************************:.*   *:*********

ISOM-4187    VQDILAPGDRVFGLVGGGFGAVAIADRRMLGVIPDGWSFTTAASVPVVEATAYGLVDLAG
Module 1     VQDILAPGDRVFGLVGGGFGAVAIADRRMLGVIPDGWSFTTAASVPVVEATAYGLVDLAG
Module 7     VQDILAPGDRVFGLVGGGFGAVAIADRRMLGVIPDGWSFTTAASVPVVEATAYGLVDLAG
             ************************************************************

ISOM-4187    LSAGESVLIHAAAGGVGMAATQIARHLGARIYATASTGKQHVLREAGLEDARIGDSRTTG
Module 1     LSAGESVLIHAAAGGVGMAATQIARHLGARIYATASTGKQHILREAGIEDTHIADSRTLS
Module 7     LSAGESVLIHAAAGGVGMAATQIARHLGARIYATASTGKQHVLREAGIEDARIGDSRTTG
             *****************************************::****:**:  .****  .
```

FIG. 15M

ISOM-4192

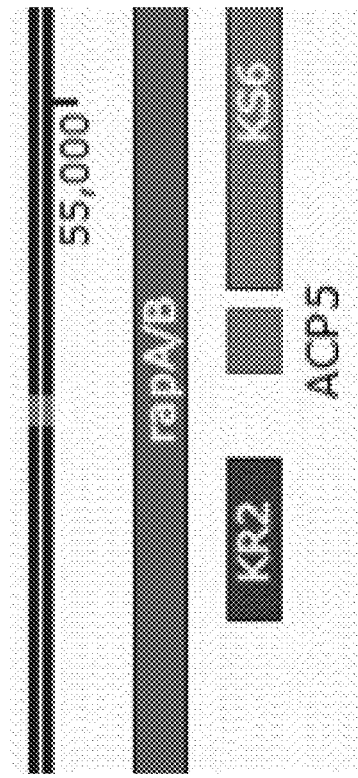

ISOM-4192    TAQLTDTDRDRIRRGGILRAISAEHGMGLFDSASRHSEPVLVAAPMEPVRDAEVPALLRSL
Module 2     TAQLTDTDRDRIRRGGILRAISAEHGMGLFDSASRHSEPVLVAAPMEPVRDAEVPALLRSL
Module 5     TAQLTDTDRDRIRRGGILRAISAEHGMRLFDNASRHSEPVLVAAPMEPVRDAEVPALLRSL
             ************************ :*********************************

ISOM-4192    HRPNVRRAALAGGAQWLAALAPEERAKALLKVVRDTAATVLGHADARTIPVTGAFRDLGI
Module 2     HRPIARRAAAGGARWLAALAPAEREKALLKVVRDTAATVLGHADARTIPVTGAFRDLGV
Module 5     HRPNVRRAALAGGAQWLAALAPEERAKALLKVVRDTAATVLGHADARTIPVTGAFRDLGI
             *  .**  *:********.:.********************:****.:

FIG. 15N

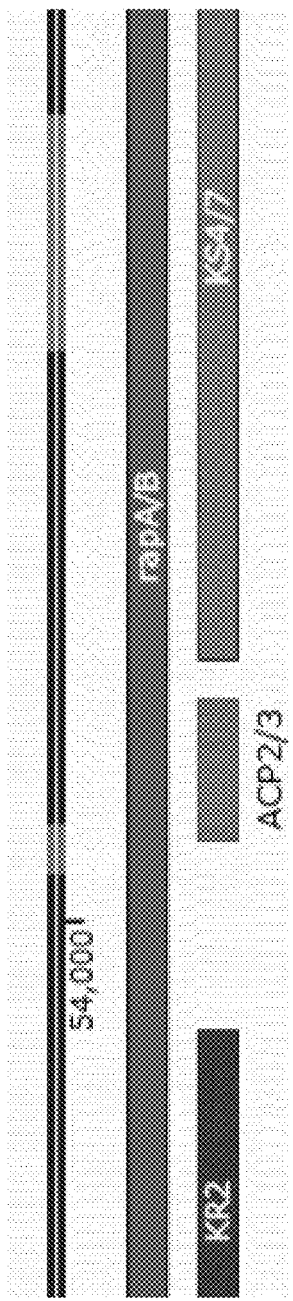

```
ISOM-4279    LIRSLHRPIARRAA-APGGARWLAALAPAEREKALLKLVCDSAAMVLGHADARSIPAAGA
Module 2     LIRSLHRPIARRAA-APGGARWLAALAPAEREKALLKLVCDSAATVLGHADTSTVSVAAV
Module 3     LIRSLRRPIARRAASADGGVQWLAALAPAEREKALLKLVCDSAAMVLGHADARSIPAAGA
             ****:***:*****  ****:****************:****.:::*.::..*.::

ISOM-4279    IGAFPVGYGAGFDREGYGATSGPSVLSGRVSYVFGLEGPAITMDTACSSLVALHLAAQA
Module 4 I   GAFPVGYGAGFDREGYGATSGPSVLSGRVSYVFGLEGPAITMDTACSSLVALHLAAQA
Module 7     IGAFPVGYGAGAAREGYGATAAPNVLSGRISYFFGLEGPAITMDTACSSLVALHLAAQA
             *******.***  :******:. .****:**:.****************

ISOM-4279    LRNGECSMALAGGVTVMATPEVFTEFAPQRGLASDGRCKAFADSADGAGFSEGAGLLIVE
Module 4     LRNGECSMALAGGVTVMATPEVFTEFAPQRGLASDGRCKAFADSADGAGFSEGAGLLIVE
Module 7     LRNGECSMALAGGVTVMATPEVFTEFAPQRGLASDGRCKAFADSADGAGFSEGAGILIVE
             ***********************************************:****

ISOM-4279    RLSDARRNGHQVLAVVRGSAVNQDGASNGFTAPNGPAQQRVIRQALANAGLTTAEVDVVE
Module 4     RLSDARRNGHQVLAVVRGSAVNQDGASNGLTAPNGPSQQRVIRAALSNAGLSTADVDVVE
Module 7     RLSDARRNGHQVLAVVRGSAVNQDGASNGFTAPNGPAQQRVIRQALANAGLTTAEVDVVE
             ****************************:****** ******:**:***:**:****
```

FIG. 15P

ISOM-4280

```
ISOM-4280  LLRSLHRPIARRAA-AAGGARWLAALAPAEREKALIKLVCDSAAMVLGHADARSIPAAGA
Module 2   LLRSLHRPIARRAA-AAGGARWLAALAPAEREKALIKLVCDSAATVLGHADTSTVSVAAV
Module 3   LLRSLRPPIARRAASADGGVQWLAALAPAEREKALIKLVCDSAAMVLGHADARSIPAAGA
           ****:****:****  .  ******************** ******** :: *.**
```

FIG. 15Q

ISOM-4291

```
ISOM-4291   LLRSLHRPIARRAA-AAGGARWLAALAPAEREKALLKLVCDSAAMVLGHADARSIPAAGA
Module 2    LLRSLHRPIARRAA-AAGGARWLAALAPAEREKALLKLVCDSAATVLGHADTSTVSVAAV
Module 3    LLRSIRRPIARRAASADGGVQWLAALAPAEREKALLKLVCDSAAMVLGHADARSIPAAGA
            ****::*******  * **.********************:*****::*:.:*:*.
```

FIG. 15R

ISOM-4359

```
ISOM-4359  VTRSLFEHRAVLLGDDSVTGTGTAVSDPRVVFVFPGQGWQWLGMGSALRDSSIVFAERMA
Module 1   VTRSLFEHRAVLLGDDSVTGTGTAVSDPRVVFVFPGQGWQWLGMGSALRTSSMVFAERMA
Module 6   VTRSVFEHRAVLLGDDTVTG--TAVSDPRVVFVFPGQGWQWLGMGSALRDSSIVFAERMA
           ****:*********** :***  ***********************:**:*****
```

FIG. 15S

ISOM-4867

| AT2/11 | DH2/11 | KR2/11 | ACP2/11 |

55,000'

```
ISOM-4867   LLIESWGVRPDAVVGHSVGELAAGYTVSGLWSLEDACTLVSARARLMQALPAGGVMVAVPVS
Module 2    LLIESWGVRPDAVVGHSVGELAAGYTVSGLWSLEDACTLVSARARLMQALPAGGVMVAVPVS
Module 11   LLIESWGVRPDAVIGHSVGELAAGYTVSGVWSLEDACTLVSARARLMQALPAGGVMVAVPVS
            ************:*************:***********************************

ISOM-4867   EDEARAVLGEGVEIAAVNGPSSVVLSGDEAAVLQAAEGLGKWTRLATSHAFHSARMEPML
Module 2    EDEARAVLGEGVEIAAVNGPSSVVLSGDEAAVLQAAEGLGKWTRLATSHAFHSARMEPML
Module 11   EDEARAVLGEGVEIAAVNGPSSVVLSGDEAAVLQAAEGLGKWTRLATSHAFHSARMEPML
            *:***********************************************************

/ 720 AA /

ISOM-4867   ASGLTAQLTDTDRDRIRRGGLRAISAEHGMGLFDSASRHSEPVLVAAPMEPVRDAEVPAL
Module 2    ASGLTAQLTDTDRDRIRRGGLRAISAEHGMGLFDSASRHSEPVLVAAPMEPVRDAEVPAL
Module 11   ASGLTAQLTDTDRDRIRRGGLRAISAEHGMGLFDSASRHSEPVLVAAPMEPVRDAEVPAL
            ************************************************************

ISOM-4867   LRSLHRPIARRAAAGGARWLAALAPAEREKALIKLIVSDGAATVLGHADTSTIPATTAFK
Module 2    LRSLHRPIARRAAAGGARWLAALAPAEREKALIKLIVCDSAATVISTVSVAAVFR
Module 11   LRSLHRPIARRAAAGGARWLAALAPAEREKALIKLIVSDGAATVLGHADTSTIPATTAFK
            ***************************************: :, *:
```

FIG. 15T

Tylosin sequences

ISOM-4854

```
ISOM-4854   TAEAESATTPVRSEVSESAAVFDARSGVVPVVVSGRSRVVVVREAAGRLAEVVEAAGGVGLA
Module 4    TAEAESATTPVRSEVSESAAVFDARSGVVPVVVSGRSRVVVVREAAGRLAEVVEAAGGVGLA
Module 6    TAEAESATTPVRSEVSESAAVLDARSGVVPVVVSGRSRVVVVREAAGRLAEVVEAAGGVGLA
            ********************:*****************************************

ISOM-4854   DVAVTMAGRSRFGYRAVVLARGEAELAGRLRALAGGDPDAGVVTGAVVDPETGSGGGGVV
Module 4    DVAVTMAGRSRFGYRAVVLARGEAELAGRLRALAGGDPDAGVVTGAVVDPETGSGGGGVV
Module 6    DVAVTMAGRSRFGYRAVVLARGEAELAGRLRALAGGDPDAGVVTGAVVDPETGSGGGGVV
            ************************************************************

ISOM-4854   LVFPGQGTQWVGMGAGLIGSSEVFAASMRECARALSVHVGWDLLEVVSGGAGLERVDVVQ
Module 4    LVFPGQGTQWVGMGAGLIGSSEVFAASMRECARALSVHVGWDLLEVVSGGAGLERVDVVQ
Module 6    LVFPGQGTQWVGMGAGLIGSSEVFAASMRECARALSVHVGWDLLEVVSGGAGLERVDVVQ
            ************************************************************

ISOM-4854   PVTWAVMVSLARYWQAMGVDVAAVVGHSQGEIAAATVAGALSLEDAAAVVALRAGLIGRY
Module 4    PVTWAVMVSLARYWQAMGVDVAAVVGHSQGEIAAATVAGALSLEDAAAVVALRAGLIGRY
Module 6    PVTWAVMVSLARYWQAMGVDVAAVVGHSQGEIAAATVAGALSLEDAAAVVALRAGLIGRY
            ************************************************************
```

FIG. 15V

```
ISOM-4854  LAGRGAMAAVPLPAGEVEAGLAKWPGVEVAAVNGPASTVVSGDRRAVAGYVAVCQAEGVQ
Module 4   LAGRGAMAAVPLPAGEVEAGLAKWPGVEVAAVNGPASTVVSGDRRAVAGYVAVCQAEGVQ
Module 6   LAGRGAMAAVPLPAGEVEAGLAKWPGVEVAAVNGPASTVVSGDRRAVAGYVAVCQAEGVQ
           ************************************************************

ISOM-4854  ARLIPVDYASHSRHVEDIKGELERVLSGIRPRSPRVPVCSTVAGEQPGEPVFDAGYWFRN
Module 4   ARLIPVDYASHSRHVEDIKGELERVLSGIRPRSPRVPVCSTVAGEQPGEPVFDAGYWFRN
Module 6   ARLIPVDYASHSRHVEDIKGELERVLSGIRPRSPRVPVCSTVAGEQPGEPVFDAGYWFRN
           ************************************************************

ISOM-4854  LRNRVEFSAVVGGLIEEGHRRFIEVSAHPVLVHAIEQTAEAADRSVHATGTLRRQDDSPH
Module 4   LRNRVEFSAVVGGLIEEGHRRFIEVSAHPVLVHAIEQTAEAADRSVHATGTLRRQDDSPH
Module 6   LRNRVEFSAVVGGLIEEGHRRFIEVSAHPVLVHAIEQTAEAADRSVHATGTLRRQDDSPH
           ************************************************************

ISOM-4854  RLLTSTAEAWAHGATLTWDPALPPGHLTTLPTYPENHHHYWLDTTPTTPATTTQSPT--
Module 4   RLLTSTAEAWAHGATLTWDPALPPGHLTTLPTYPENHHHYWLDTTPTTPATTTQSPTDAC
Module 6   RLLTSTAEAWAHGATLTWDPALPPGHLTTLPTYPENHHHYWLDTTPTTPATTTQSPT--
           ********************************************************
```

FIG. 15W

```
ISOM-4855    LAGRGAMAAVPLPAGEVEAGLAKWPGVEVAAVNGPASTVVSGDRRAVAGYVAVCQAEGVQ
Module 4     LAGRGAMAAVPLPAGEVEAGLAKWPGVEVAAVNGPASTVVSGDRRAVAGYVAVCQAEGVQ
Module 6     LAGRGAMAAVPLPAGEVEAGLAKWPGVEVAAVNGPASTVVSGDRRAVAGYVAVCQAEGVQ
             ************************************************************

ISOM-4855    ARLIPVDYASHSRHVEDLKGELERVLSGIRPRSPRVPVCSTVAGEQPGEPVEDAGYWFRN
Module 4     ARLIPVDYASHSRHVEDLKGELERVLSGIRPRSPRVPVCSTVAGEQPGEPVEDAGYWFRN
Module 6     ARLIPVDYASHSRHVEDLKGELERVLSGIRPRSPRVPVCSTVAGEQPGEPVEDAGYWFRN
             ************************************************************

ISOM-4855    LRNRVEFSAVVGGLIEEGHRRFIEVSAHPVLVHAIEQTAEAADRSVHATGTLRRQDDSPH
Module 4     LRNRVEFSAVVGGLIEEGHRRFIEVSAHPVLVHAIEQTAEAADRSVHATGTLRRQDDSPH
Module 6     LRNRVEFSAVVGGLIEEGHRRFIEVSAHPVLVHAIEQTAEAADRSVHATGTLRRQDDSPH
             ************************************************************

ISOM-4855    RLLTSTAEAWAHGATLTWDPALPPGHLTTLPTYPFNHHHYWLDTTPTTPATTTQSPT--
Module 4     RLLTSTAEAWAHGATLTWDPALPPGHLTTLPTYPFNHHHYWLDTTPTTPATTTQSPTDAQ
Module 6     RLLTSTAEAWAHGATLTWDPALPPGHLTTLPTYPFNHHHYWLDTTPTTPATTTQSPT--
             ********************************************************
```

FIG. 15Y

ISOM-4897

| | 38,000 | | | 40,000 | |
|---|---|---|---|---|---|

ISOM-4897     TAEAESATTPVRSEVSESAAVEDARSGVPVVVSGRSRVVVREAAGRLAEVVEAAGGVGLA
Module 4      TAEAESATTPVRSEVSESAAVEDARSGVPVVVSGRSRVVVREAAGRLAEVVEAAGGVGLA
Module 6      TAEAESATTPVRSEVSESAAVLDARSGVPVVVSGRSRVVVREAAGRLAEVVEAAGGVGLA
              *******************:************************************

ISOM-4897     DVAVTMAGRSRFGYRAVVLARGEAELAGRLRALAGGDPDAGVVTGAVVDPETGSGGGGVV
Module 4      DVAVTMAGRSRFGYRAVVLARGEAELAGRLRALAGGDPDAGVVTGAVVDPETGSGGGGVV
Module 6      DVAVTMAGRSRFGYRAVVLARGEAELAGRLRALAGGDPDAGVVTGAVVDPETGSGGGGVV
              ************************************************************

ISOM-4897     LVFPGQGTQWVGMGAGLLGSSEVFAASMRECARALSVHVGWDLLEVVSGGAGLERVDVVQ
Module 4      LVFPGQGTQWVGMGAGLLGSSEVFAASMRECARALSVHVGWDLLEVVSGGAGLERVDVVQ
Module 6      LVFPGQGTQWVGMGAGLLGSSEVFAASMRECARALSVHVGWDLLEVVSGGAGLERVDVVQ
              ************************************************************

ISOM-4897     PVTWAVMVSLARYWQAMGVDVAAVVGHSQGEIAAATVAGALSIEDAAAVVALRAGLIGRY
Module 4      PVTWAVMVSLARYWQAMGVDVAAVVGHSQGEIAAATVAGALSIEDAAAVVALRAGLIGRY
Module 6      PVTWAVMVSLARYWQAMGVDVAAVVGHSQGEIAAATVAGALSIEDAAAVVALRAGLIGRY
              ************************************************************

FIG. 15Z

```
ISOM-4897   LAGRGAMAAVPLPAGEVEAGLAKWPGVEVAAVNGPASTVVSGDRRAVAGYVAVCQAEGVQ
Module 4    LAGRGAMAAVPLPAGEVEAGLAKWPGVEVAAVNGPASTVVSGDRRAVAGYVAVCQAEGVQ
Module 6    LAGRGAMAAVPLPAGEVEAGLAKWPGVEVAAVNGPASTVVSGDRRAVAGYVAVCQAEGVQ
            ************************************************************

ISOM-4897   ARLIPVDYASHSRHVEDLKGELERVLSGIRPRSPRVPVCSTVAGEQPGEPVEDAGYWFRN
Module 4    ARLIPVDYASHSRHVEDLKGELERVLSGIRPRSPRVPVCSTVAGEQPGEPVEDAGYWFRN
Module 6    ARLIPVDYASHSRHVEDLKGELERVLSGIRPRSPRVPVCSTVAGEQPGEPVEDAGYWFRN
            ************************************************************

ISOM-4897   LRNRVEFSAVVGGLIEEGHRRFIEVSAHPVLVHAIEQTAEAADRSVHATGTLRRQDDSPH
Module 4    LRNRVEFSAVVGGLIEEGHRRFIEVSAHPVLVHAIEQTAEAADRSVHATGTLRRQDDSPH
Module 6    LRNRVEFSAVVGGLIEEGHRRFIEVSAHPVLVHAIEQTAEAADRSVHATGTLRRQDDSPH
            ************************************************************

ISOM-4897   RLLTSTAEAWAHGATLTWDPALPPGHLTTTLPTYPFNHHHYWLDTTPTTPATTTQSPT--
Module 4    RLLTSTAEAWAHGATLTWDPALPPGHLTTTLPTYPFNHHHYWLDTTPTTPATTTQSPTDAQ
Module 6    RLLTSTAEAWAHGATLTWDPALPPGHLTTTLPTYPFNHHHYWLDTTPTTPATTTQSPT--
            *********************************************************
```

FIG. 15AA

```
ISOM-5004   AGVMPQEYGPRLAEGAEGSDGYLLTGTSGSVVSGRVAYTLGLEGPAVTVDTACSSSLVAL
Module1     AGVMPQEYGPRLAEGAEGSDGYLLTGTSGSVVSGRVAYTLGLEGPAVTVDTACSSSLVAL
Module4     AGVMHDYGTGQTS-ATDTSGYSGTGTSGSVVSGRVAYTLGLEGPAVTVDTACSSSLVAL
            ****.;** .  *  ..;** *****************************

ISOM-5004   HLAVQALRGGECDMALAGGVTVMAGPGMFVEFSRQRGLAADGRCKAFADGADGTAWAEGA
Module1     HLAVQALRGGECDMALAGGVTVMAGPGMFVEFSRQRGLAADGRCKAFADGADGTAWAEGA
Module4     HLAVQALRGGECDMALAGGVTVMAGPGMFVEFSRQRGLAADGRCKAFADGADGTAWAEGA
            ************************************************************

ISOM-5004   GVVLVERLSDARRLGHPVLAVVCGSAVNQDGASNGLTAPSGPSQERVIRQALGNARLTVA
Module1     GVVLLQRLSDARRLGRPVLAVVCGSAVNQDGASNGLTAPSGPSQERVIRQALGNARLTVA
Module4     GVVLVERLSDARRLGHPVLAVVCGSAVNQDGASNGLTAPSGPSQERVIRQALANARLTVA
            ****;;********* *;****************************************.*******

ISOM-5004   AGVMPQEYGPRLAEGAEGSDGYLLTGTSGSVVSGRVAYTLGLEGPAVTVDTACSSSLVAL
Module1     AGVMPQEYGPRLAEGAEGSDGYLLTGTSGSVVSGRVAYTLGLEGPAVTVDTACSSSLVAL
Module4     AGVMHDYGTGQTS-ATDTSGYSGTGTSGSVVSGRVAYTLGLEGPAVTVDTACSSSLVAL
            ****.;** .  *  ..;** *****************************

ISOM-5004   HLAVQALRGGECDMALAGGVTVMAGPGMFVEFSRQRGLAADGRCKAFADGADGTAWAEGA
Module1     HLAVQALRGGECDMALAGGVTVMAGPGMFVEFSRQRGLAADGRCKAFADGADGTAWAEGA
Module4     HLAVQALRGGECDMALAGGVTVMAGPGMFVEFSRQRGLAADGRCKAFADGADGTAWAEGA
            ************************************************************

ISOM-5004   GVVLVERLSDARRLGHPVLAVVCGSAVNQDGASNGLTAPSGPSQERVIRQALGNARLTVA
Module1     GVVLLQRLSDARREGRPVLAVVCGSAVNQDGASNGLTAPSGPSQERVIRQALGNARLTVA
Module4     GVVLVERLSDARRLGHPVLAVVCGSAVNQDGASNGLTAPSGPSQERVIRQALANARLTVA
            ****;;********* *;****************************************.*******

ISOM-5004   DVDVVEAHGTGTRLGDPIEAQALLGTYGRDRDGGRPVWLGSLKSNIGHAQAAAGVAGVIK
Module1     DVDVVEAHGTGTRLGDPIEAQALLGTYGRDRDGGRPVWLGSLKSNIGHAQAAAGVAGVIK
Module4     DVDVVEAHGTGTRLGDPIEAQALLGTYGRDRDGGRPVWLGSLKSNIGHAQAAAGVAGVIK
            ************************************************************

ISOM-5004   MVLAMRYGWLPRTLHVDEPSRHVDWSAGGVWLLTEAREWPGVDRPRRAAVSAFGVSGTNA
Module1     MVLAMRYGWLPRTLHVDEPSRHVDWSAGGVWLLTEAREWPGVDRPRRAAVSAFGVSGTNA
Module4     MVLAMRYGWLPRTLHVDEPSRHVDWSAGGVWLLTEAREWPGVDRPRRAAVSAFGVSGTNA
            ************************************************************

ISOM-5004   HLILEAPDTAEAESATTPVRSEVSESAAVFDARSGVVPVVVSGRSRVVVREAAGRLAEVV
Module1     HLILEAPDTAEAESATTPVRSEVSESAAVFDARSGVVPVVVSGRSRVVVREAAGRLAEVV
Module4     HLILEAPDTAEAESATTPVRSEVSESAAVFDARSGVVPVVVSGRSRVVVREAAGRLAEVV
            ************************************************************

ISOM-5004   EAGGVGLADVAVTMAGRSRFGYRAVVLARGEAELAGRLRALAGGDPDAGVVTGAVVDPET
Module1     EAGGVGLADVAVTMAGRSRFGYRAVVLARGEAELAGRLRALAGGDPDAGVVTGAVVDPET
Module4     EAGGVGLADVAVTMAGRSRFGYRAVVLARGEAELAGRLRALAGGDPDAGVVTGAVVDPET
            ************************************************************

ISOM-5004   GSGGGGVVLVFPGQGTQWVGMGAGLLGSSEVFAASMRECARALSVHVGWDLLEVVSGGAG
Module1     GSGGGGVVLVFPGQGTQWVGMGAGLLGSSEVFAASMRECARALSVHVEWDLLEVVSGGAG
Module4     GSGGGGVVLVFPGQGTQWVGMGAGLLGSSEVFAASMRECARALSVHVGWDLLEVVSGGAG
            ***********************************************.***********
```

FIG. 15CC

ISOM-5005

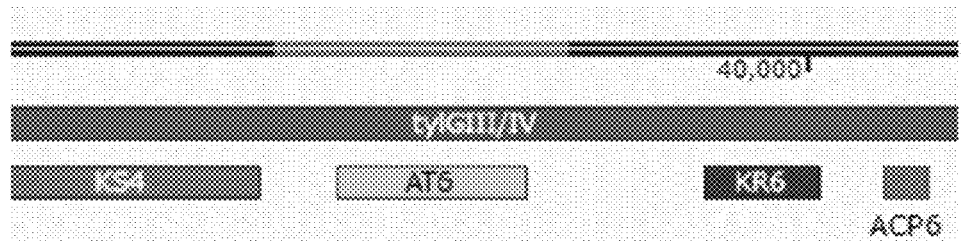

| ISOM-5005 | TAEAESATTPVRSEVSESAAVFDARSGVVPVVVSGRSRVVVREAAGRLAEVVEAGGVGLA |
|---|---|
| Module 4 | TAEAESATTPVRSEVSESAAVFDARSGVVPVVVSGRSRVVVREAAGRLAEVVEAGGVGLA |
| Module 6 | TAEAESATTPVRSEVSESAAVLDARSGVVPVVVSGRSRVVVREAAGRLAEVVEAGGVGLA |
|  | **************************:******************************** |

| ISOM-5005 | DVAVTMAGRSRFGYRAVVLARGEAELAGRLRALAGGDPDAGVVTGAVVDPETGSGGGGVV |
|---|---|
| Module 4 | DVAVTMAGRSRFGYRAVVLARGEAELAGRLRALAGGDPDAGVVTGAVVDPETGSGGGGVV |
| Module 6 | DVAVTMAGRSRFGYRAVVLARGEAELAGRLRALAGGDPDAGVVTGAVVDPETGSGGGGVV |
|  | ************************************************************ |

| ISOM-5005 | LVFPGQGTQWVGMGAGLLGSSEVFAASMRECARALSVSVGWDLLEVVSGGAGLERVDVVQ |
|---|---|
| Module 4 | LVFPGQGTQWVGMGAGLLGSSEVFAASMRECARALSVSVGWDLLEVVSGGAGLERVDVVQ |
| Module 6 | LVFPGQGTQWVGMGAGLLGSSEVFAASMRECARALSVHVGWDLLEVVSGGAGLERVDVVQ |
|  | ************************************************************ |

FIG. 15DD

```
ISOM-5005    PVTWAVMVSLARYWQAMGVDVAAVVGHSQGEIAAATVAGALSLEDAAAVVALRAGLIGRY
Module4      PVTWAVMVSLARYWQAMGVDVAAVVGHSQGEIAAATVAGALSLEDAAAVVALRAGLIGRY
Module6      PVTWAVMVSLARYWQAMGVDVAAVVGHSQGEIAAATVAGALSLEDAAAVVALRAGLIGRY
             ************************************************************

ISOM-5005    LAGRGAMAAVPLPAGEVEAGLAKWPGVEVAAVNGPASTVVSGDRRAVAGYVAVCQAEGVQ
Module4      LAGRGAMAAVPLPAGEVEAGLAKWPGVEVAAVNGPASTVVSGDRRAVAGYVAVCQAEGVQ
Module6      LAGRGAMAAVPLPAGEVEAGLAKWPGVEVAAVNGPASTVVSGDRRAVAGYVAVCQAEGVQ
             ************************************************************

ISOM-5005    ARLIPVDYASHSRHVEDLKGELERVLSGIRPRSPRVPVCSTVAGEQPGEPVFDAGYWFRN
Module4      ARLIPVDYASHSRHVEDLKGELERVLSGIRPRSPRVPVCSTVAGEQPGEPVFDAGYWFRN
Module6      ARLIPVDYASHSRHVEDLKGELERVLSGIRPRSPRVPVCSTVAGEQPGEPVFDAGYWFRN
             ************************************************************

ISOM-5005    LRNRVEFSAVVGGLLEEGHRRFIEVSAHPVLVHAIEQTAEAADRSVHATGTLRRQDDSPH
Module4      LRNRVEFSAVVGGLLEEGHRRFIEVSAHPVLVHAIEQTAEAADRSVHATGTLRRQDDSPH
Module6      LRNRVEFSAVVGGLLEEGHRRFIEVSAHPVLVHAIEQTAEAADRSVHATGTLRRQDDSPH
             ************************************************************

ISOM-5005    RLLTSTAEAWAHGATLTWDPALPPGHLTTLPTYPFNHHYWLDTTPTTPATTTQSPT-----
Module4      RLLTSTAEAWAHGATLTWDPALPPGHLTTLPTYPFNHHYWLDTTPTTPATTTQSPTDAQ
Module6      RLLTSTAEAWAHGATLTWDPALPPGHLTTLPTYPFNHHYWLDTTPTTPATTTQSPT---
             ********************************************************
```

FIG. 15EE

ISOM-5008

[Diagram showing 22,500¹ with labeled regions including CoA/T1, LS, AT1, KR4]

```
ISOM-5008   VFPGQGTQWVGMGAGLLGSSEVFAASMRECARALSVRVEWDLLEVVSGGAGLERVDVVQP
Module 1    VFPGQGTQWVGMGAGLLGSSEVFAASMRECARALSVRVEWDLLEVVSGGAGLERVDVVQP
Module 4    VFPGQGTQWVGMGAGLLGSSEVFAASMRECARALSVRVGWDLLEVVSGGAGLERVDVVQP
            ************************************* **********************

ISOM-5008   VTWAVMVSLARYWQAMGVDVAAVGHSQGEIAAATVAGALSLEDAAAVVALRAGLIGRYL
Module 1    VTWAVMVSLARYWQAMGVDVAAVGHSQGEIAAATVAGALSLEDAAAVVALRAGLIGRYL
Module 4    VTWAVMVSLARYWQAMGVDVAAVGHSQGEIAAATVAGALSLEDAAAVVALRAGLIGRYL
            **********************************************************

ISOM-5008   AGRGAMAAVPLPAGEVEAGLAKWPGVEVAAVNGPASTVVSGDRRAVAGYVAVCQAEGVQA
Module 1    AGRGAMAAVPLPAGEVEAGLAKWPGVEVAAVNGPASTVVSGDRRAVAGYVAVCQAEGVQA
Module 4    AGRGAMAAVPLPAGEVEAGLAKWPGVEVAAVNGPASTVVSGDRRAVAGYVAVCQAEGVQA
            ************************************************************

ISOM-5008   RLIPVDYASHSRHVEDLKGELERVLSGIRPRSPRVPVCSTVAGEQPGEPVFDAGYWFRNL
Module 1    RLIPVDYASHSRHVEDLKGELERVLSGIRPRSPRVPVCSTVAGEQPGEPVFDAGYWFRNL
Module 4    RLIPVDYASHSRHVEDLKGELERVLSGIRPRSPRVPVCSTVAGEQPGEPVFDAGYWFRNL
            ************************************************************

ISOM-5008   RNRVEFSAVVGGLLEEGHRRFIEVSAHPVLVHAIEQTAEAADRSVRATGTLRRQDDSPHR
Module 1    RNRVEFSAVVGGLLEEGHRRFIEVSAHPVLVHAIEQTAEAADRSVRATGTLRRQDDSPHR
Module 4    RNRVEFSAVVGGLLEEGHRRFIEVSAHPVLVHAIEQTAEAADRSVRATGTLRRQDDSPHR
            ************************************************************

ISOM-5008   LLTSTAEAWAHGATLTWDPALPPGHLTTLPTYPFNHHHYWLDTTPTTPATTTQSPTDAQN
Module 1    LLTSTAEAWAHGATLTWDPALPPGHLTTLPTYPFNHHHYWLDTTPTTPATTTQSPT-----
Module 4    LLTSTAEAWAHGATLTWDPALPPGHLTTLPTYPFNHHHYWLDTTPTTPATTTQSPTDAQN
            *******************************************************
```

FIG. 15FF

ISOM-5009

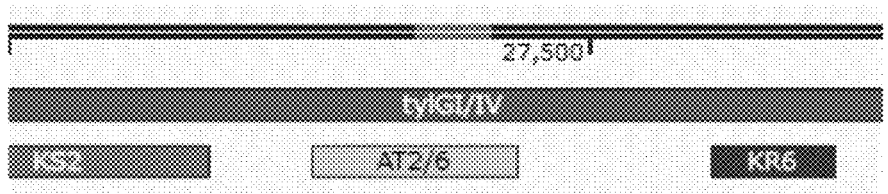

```
ISOM-5009   AGRGAMAAVPLPAGEVEAGLAKWPGVQVAAVNGPASTVVSGDRRAVAGYVAVCQAEGVQA
Module 2    AGRGAMAAVPLPAGEVEAGLAKWPGVQVAAVNGPASTVVSGDRRAVAGYVAVCQAEGVQA
Module 6    AGRGAMAAVPLPAGEVEAGLAKWPGVEVAAVNGPASTVVSGDRRAVAGYVAVCQAEGVQA
            *********************************:**************************

ISOM-5009   RLIPVDYASHSRHVEDLKGELERVLSGIRPRSPRVPVCSTVAGEQPGEPVFDAGYWFRNL
Module 2    RLIPVDYASHSRHVEDLKGELERVLSGIRPRSPRVPVCSTVAGEQPGEPVFDAGYWFRNL
Module 6    RLIPVDYASHSRHVEDLKGELERVLSGIRPRSPRVPVCSTVAGEQPGEPVFDAGYWFRNL
            ************************************************************

ISOM-5009   RNRVEFSAVVGGLLEEGHRRFIEVSAHPVLVHAIEQTAEAADRSVHATGTLRRQ
Module 2    RNRVEFSAVVGGLLEQGHRRFIEVSAHPVLVHAIEQTAEAADRSVHATGTLRRQ
Module 6    RNRVEFSAVVGGLLEEGHRRFIEVSAHPVLVHAIEQTAEAADRSVHATGTLRRQ
            ***************:*************************************
```

FIG. 15GG

ISOM-5010

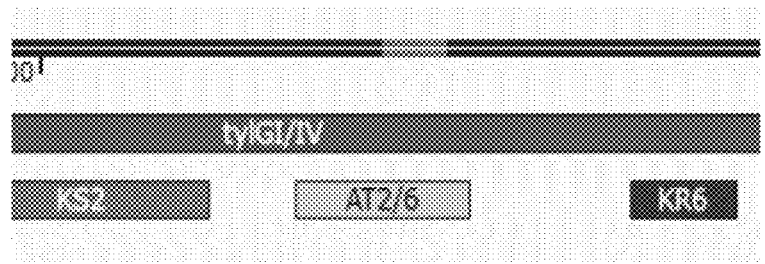

ISOM-5010   AGRGAMAAVPLPAGEVEAGLAKWPGVQVAAVNGPASTVVSGDRRAVAGYVAVCQAEGVQA
Module2     AGRGAMAAVPLPAGEVEAGLAKWPGVQVAAVNGPASTVVSGDRRAVAGYVAVCQAEGVQA
Module6     AGRGAMAAVPLPAGEVEAGLAKWPGVEVAAVNGPASTVVSGDRRAVAGYVAVCQAEGVQA
            **************************:*****************************

ISOM-5010   RLIPVDYASHSRHVEDLKGELERVLSGIRPRSPRVPVCSTVAGEQPGEPVFDAGYWFRNL
Module2     RLIPVDYASHSRHVEDLKGELERVLSGIRPRSPRVPVCSTVAGEQPGEPVFDAGYWFRNL
Module6     RLIPVDYASHSRHVEDLKGELERVLSGIRPRSPRVPVCSTVAGEQPGEPVFDAGYWFRNL
            ************************************************************

ISOM-5010   RNRVEFSAVVGGLLEEGHRRFIEVSAHPVLVHAIEQTAEAADRSVHATGTLRRQ
Module2     RNRVEFSAVVGGLLEQGHRRFIEVSAHPVLVHAIEQTAEAADRSVHATGTLRRQ
Module6     RNRVEFSAVVGGLLEEGHRRFIEVSAHPVLVHAIEQTAEAADRSVHATGTLRRQ
            *************:***********************************

FIG. 15HH

ISOM-5051

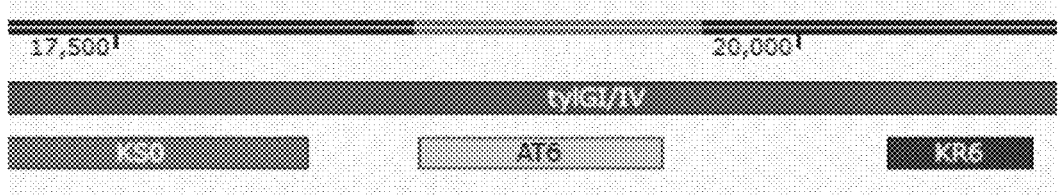

```
ISOM-5051    AGAAGGAGAAGGAGGGGVVLVFPGQGTQWVGMGAGLLGSSEVFAASMRECARALSVHVGW
Module 0     AGAAGGAGAAGGAGGGGVVLVFPGQGTQWVGMGAGLLGSSEVFAASMRECARALSVHVGW
Module 6     -----------ETGSGGGGVVLVFPGQGTQWVGMGAGLLGSSEVFAASMRECARALSVHVGW
                        *:************************************************

ISOM-5051    DLLEVVSGGAGLERVDVVQPVTWAVMVSLARYWQAMGVDVAAVVGHSQGEIAAATVAGAL
Module 0     DLLEVVSGGAGLERVDVVQPVTWAVMVSLARYWQAMGVDVAAVVGHSQGEIAAATVAGAL
Module 6     DLLEVVSGGAGLERVDVVQPVTWAVMVSLARYWQAMGVDVAAVVGHSQGEIAAATVAGAL
             ************************************************************

ISOM-5051    SLEDAAAVVALRAGLIGRYLAGRGAMAAVPLPAGEVEAGLAKWPGVEVAAVNGPASTVVS
Module 0     SLEDAAAVVALRAGLIGRYLAGRGAMAAVPLPAGEVEAGLAKWPGVEVAAVNGPASTVVS
Module 6     SLEDAAAVVALRAGLIGRYLAGRGAMAAVPLPAGEVEAGLAKWPGVEVAAVNGPASTVVS
             ************************************************************
```

FIG. 15II

```
ISCM-5051   GDRRAVAGYVAVCQAEGVQARLIPVDYASHSRHVEDLKGELERVLSGIRPRSPRVPVCST
Module 0    GDRRAVAGYVAVCQAEGVQARLIPVDYASHSRHVEDLKGELERVLSGIRPRSPRVPVCST
Module 6    GDRRAVAGYVAVCQAEGVQARLIPVDYASHSRHVEDLKGELERVLSGIRPRSPRVPVCST
            ************************************************************

ISCM-5051   VAGEQPGEPVFDAGYWFRNLRNRVEFSAVVGGLLEEGHRRFIEVSASPVLVHAIEQTAEA
Module 0    VAGEQPGEPVFDAGYWFRNLRNRVEFSAVVGGLLEEGHRRFIEVSAHPVLVHAIEQTAEA
Module 6    VAGEQPGEPVFDAGYWFRNLRNRVEFSAVVGGLLEEGHRRFIEVSASPVLVHAIEQTAEA
            **********************************************************

ISCM-5051   ADRSVHATGTLRRQDDSPHRLLTSTAEAWAHGATLTWDPALPPGHLTTLPTYPFNHHHYW
Module 0    ADRSVHATGTLRRQDDSPHRLLTSTAEAWAHGATLTWDPALPPGHLTTLPTYPFNHHHYW
Module 6    ADRSVHATGTLRRQDDSPHRLLTSTAEAWAHGATLTWDPALPPGHLTTLPTYPFNHHHYW
            ************************************************************

ISCM-5051   LDTTPTTPATTYQSPTDAWRYRVTWKALTEESTPASSPSGHWLLVTPPTPEGRTLGDRAA
Module 0    LDTIDGGGGDDATQEKESGPLTRELR-----GLPSSQKQLGFLL----------------
Module 6    LDTTPTTPATTYQSPTDAWRYRVTWKALTEESTPASSPSGHWLLVTPPTPEGRTLGDRAA
            ***  .  :  ,.::       :      ,  *;*.  ,   :**
```

FIG. 15JJ

ISOM-5054

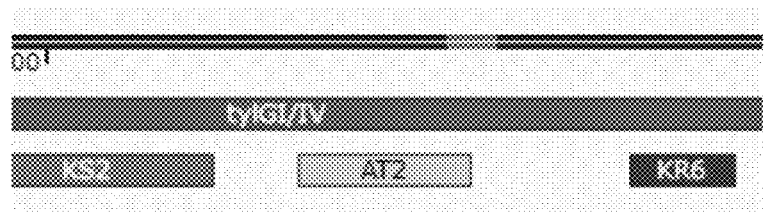

```
ISOM-5054   AGRGAMAAVPLPAGEVEAGLAKWPGVQVAAVNGPASTVVSGDRRAVAGYVAVCQAEGVQA
Module2     AGRGAMAAVPLPAGEVEAGLAKWPGVQVAAVNGPASTVVSGDRRAVAGYVAVCQAEGVQA
Module6     AGRGAMAAVPLPAGEVEAGLAKWPGVEVAAVNGPASTVVSGDRRAVAGYVAVCQAEGVQA
            ************************* :*********************************

ISOM-5054   RLIPVDYASHSRHVEDLKGELERVLSGIRPRSPRVPVCSTVAGEQPGEPVFDAGYWFRNL
Module2     RLIPVDYASHSRHVEDLKGELERVLSGIRPRSPRVPVCSTVAGEQPGEPVFDAGYWFRNL
Module6     RLIPVDYASHSRHVEDLKGELERVLSGIRPRSPRVPVCSTVAGEQPGEPVFDAGYWFRNL
            ************************************************************

ISOM-5054   RNRVEFSAVVGGLLEEGHRRFIEVSAHPVLVHAIEQTAEAADRSVHATGTLRRQDDSPHR
Module2     RNRVEFSAVVGGLLEQGHRRFIEVSAHPVLVHAIEQTAEAADRSVHATGTLRRQDDSPHR
Module6     RNRVEFSAVVGGLLEEGHRRFIEVSAHPVLVHAIEQTAEAADRSVHATGTLRRQDDSPHR
            ***************:********************************************
```

FIG. 15KK

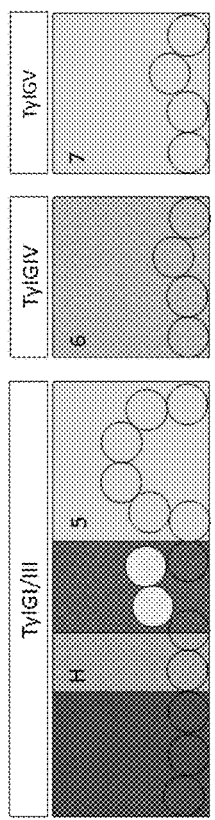
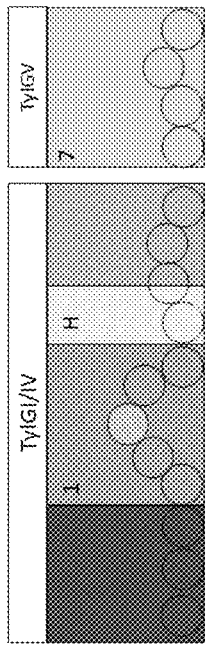
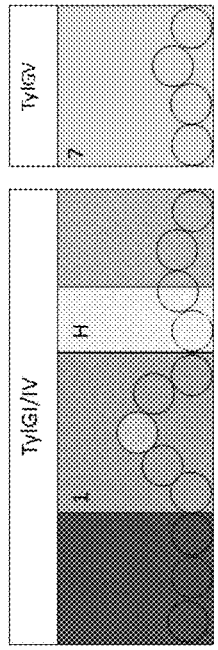
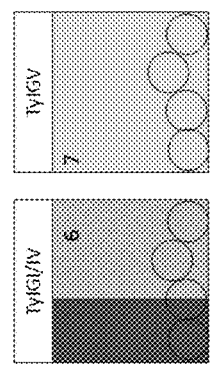
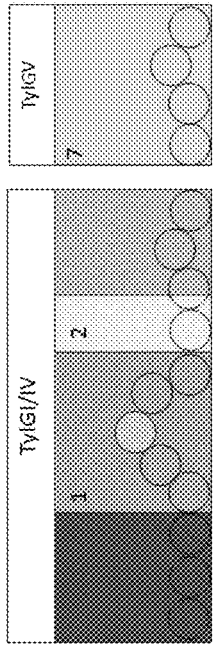
ISOM-5008　ISOM-5009　ISOM-5010　ISOM-5051　ISOM-5054
FIG. 16B

FK506

METHODS FOR PRODUCING HYBRID POLYKETIDE SYNTHASE GENES AND POLYKETIDES

This application is a § 371 application of PCT/GB2017/052221, filed Jul. 28, 2017, which in turn claims priority to GB Application No. 1613130.2, filed Jul. 29, 2016, and GB Application No. 1703657.5, filed Mar. 7, 2017. The entire disclosure of each of the foregoing applications is incorporated by reference herein.

Incorporated herein by reference in its entirety is the Sequence Listing being concurrently submitted via EFS-Web as a text file named SeqList.txt, created Jun. 14, 2023, and having a size of 649,226 bytes.

Background of the invention

Discovery and development of small molecules and natural products (NPs) that bind to protein targets, such as polyketides (PKs) and non-ribosomal peptides (NRPs) can be a slow and expensive process. Typically, the small molecules or NPs are produced, isolated, purified (partially or fully) then tested against in vitro screens for activity against the target of interest (Lahlou, 2013). This usually requires generating a large library, which is a costly investment for even hundreds or thousands of compounds. Meanwhile, methods for selecting monoclonal antibody biologics (mAbs) use phage-based selection systems, such as biopanning (Varaldo et al., 1997, Smith 1985, Parmley et al. 1988, Burioni et al., 1997), whereby variants of the product are produced and the phage producing the product of interest is selected for, enabling rapid screening of binding sites without the need to produce and isolate the mAbs.

As PKs and NRPs are genetically encoded, there is an opportunity to generate a library produced within a cellular system. However, historical efforts to produce effective diversity libraries have struggled, due to poor production and narrow breadth (Weissman 2005, Weissman 2016). In addition, whilst many groups have suggested methods of directed evolution of polyketides and non-ribosomal peptides through a variety of different screening and selection methods (eg see review by Rui and Zhang 2016), to our knowledge no-one has previously described a functional selection system for a cellular-produced natural product library based on binding to a variable protein target within that cell. These methods are all limited by the breadth of molecules they can select and the effort required to carry out any form of screen or selection, limiting the size of library that can be selected from or screened. Most of these previous methods are also limited to only part of the biosynthetic machinery, potentially leading to a disturbance to the overall balance of the biosynthatic network. The closest systems in terms of potential breadth of chemistry are probably those which require in vitro or phage display systems. These are limited to peptidic libraries, which limits the potential diversity which can be accessed and can lead to issues with cell-membrane permeability and other properties (Bashiruddin & Suga 2015).

Use of a selection system would enable a much larger library to be screened, reducing the cost of the screen and increasing the chance of successfully finding a product that binds the target protein.

Natural Product Libraries

Polyketides are produced by large multifunctional proteins containing multiple enzymatic domains. In a type 1 modular polyketide synthase, each of these domains contains the enzymatic functionality required for a particular chemical step in the biosynthesis of a final product. The modules of these enzymes always have an acyl carrier protein (ACP) with a phosphopantetheine arm upon which the intermediates are covalently linked by thioester linkages. The first 'loading' module primes the assembly line with a starter unit from a diverse array of potential options, from acetate to more complex moieties such as those related to cyclohexanecarboxylic acid and benzoate. Every module beyond the first then receives a partially completed chain from the previous module, adds a unit via a ketosynthase (KS) and acyltransferase (AT) functionality and then optionally modifies, for example by reduction, dehydration or methylation, using domains such as ketoreductases, dehydratases or enoyl reductases, the portion that was just extended, and then passes the chain to the next module.

Finally, the last module releases the completed product as either a linear chain or a macrocycle, often using a thioesterase (TE) function. Each polypeptide can carry one or many polyketide synthase (PKS) modules and optionally non-ribosomal peptide synthetase (NRPS) modules.

Certain polyketides are produced by iterative polyketide synthases which reuse enzymatic domains in a cyclic fashion. Iterative polyketide synthases (such as type 1 iterative and type 2) are not the subject of the present document Type III PKS are also not the subject of the present document Certain non-ribosomal peptides are produced by iterative non-ribosomal peptide synthetases which are aggregates of multifunctional proteins and which reuse enzymatic domains in a cyclic fashion. Iterative non-ribosomal peptide synthetases (such as fungal iterative NRPS) are not the subject of the present document Many industrial and academic groups have attempted to inactivate, remove or replace domains and modules in type 1 modular PKSs and modular NRPSs, leading to variable success in production of new chemical entities. As described in Weissman 2005, "many of these experiments fail to produce the expected polyketides (and even if they are made, the yields are depressingly low), and it is usually difficult to trace the source of the problem". Many reasons for this have been suggested, Including selectivity of ketosynthase domains or issues with tertiary structure due to junction design (Weissman 2015). Many groups have attempted both active site, domain and to a lesser extent, module swaps (e.g see review in Dunn & Khosla 2013). Module swaps have been occasionally tried before, but with varying success (Oliynyk et al., 1996, Ranganathan et al.. 1999, Del Vecchio et al., 2003). In general design of hybrid polyketide synthases, Ranganathan and other authors taught to make junctions "either in the surface-accessible linker regions between enzymatic domains" or "just inside the conserved margins of domains". Meanwhile, WO98/01546 and WO00/01927 taught similar junctions to Ranganathan et al. U.S. Pat. No. 6,753,173 taught to use N-terminal intrapolypeptide linker domains, U.S. Pat. No. 6,221,641 and WO2/14482 taught to alter the amino acid sequences of domains within the synthase, whilst most other patent applications such as U.S. Pat. Nos. 5,672,491, 5,712,146, WO93/13663, WO95/08548 and related applications taught virtually nothing about how to design junctions. None of these methods have consistently yielded highly productive novel polyketide synthases producing new chemistry (Weissman 2016).

We are now more than 20 years after many of these initial patent applications and scientific papers were published and there has been limited advancement in the productivity of hybrid polyketide syntheses. A field that has great potential in the generation of new chemical entities has therefore not yet met its full potential.

We have previously described a method for rapidly generating bacteria producing a diverse range of PKs and NRPs based on recombination (WO2015/004458). By repeatedly carrying out this method and sequencing the DNA of the resultant gene clusters, we have discovered that there are 'hotspots' of recombination which led to very productive synthases (see FIGS. 5, 13, 14, 15 and 16). By reverse engineering these junctions we have developed a method to do this in a rational sense—leading to the ability to 'design' new PKS which have much higher productivity than previous non-rational designs. The junctions used are surprising and have not been used before in design of new synthases. They fall broadly into three groups: ketosynthase to ketosynthase (Junction region 1), acyltransferase to acyltransferase (Junction region 2) and pre-ACP to pre-ACP (Junction region 3) (See FIGS. 2, 3 and 4 for alignment). Rather than making domain replacements, the productive junctions lead to effective module replacements, something that has been very difficult to do successfully before. An example of module insertions (leading to two junctions) using the three junction regions is shown in FIG. 6. We have therefore developed new methods for designing de novo PKS junctions and hybrid PKSs. These methods are much more likely to lead to productive hybrid PKS than previously described methods and junctions. This enables, and we describe, improved methods for generation of libraries of cells producing diverse array of new natural product structures by using these junctions.

Three-Hybrid Selection System

A number of three-hybrid selection systems have previously been described. They consist of two detector macromolecules (usually proteins or RNA) that, once brought together by a small molecule bifunctional ligand or 'joining' element, lead to transcription of a gene or genes, such as a reporter gene. Examples include bacterial small-molecule three-hybrid selection systems (e.g. Althoff et al., 2002), conditional protein splicing (e.g. Mootz et al., 2002, Mootz et al., 2003) and Yeast three-hybrid selection systems (e.g. Licitra et al., 1998). Three-hybrid selection systems have also been described which allow detection and analysis of interactions between RNA and proteins. Hybrid RNA binds to each of two hybrid proteins. Once this complex is formed, this activates the transcription of a reporter gene. Once the reporter gene is turned on, its expression can be identified by phenotype or by simple biochemical assay (Zhang et al., 1999).

Rapamycin is a mixed PK/NRP which contains an FKBP-binding domain and an mTOR-FRAP binding domain. When rapamycin is added to a system which contains an FKBP domain and an mTOR FRAP domain, it joins the two domains. This has been used to switch on target reporter genes, such as described in Magari et al., 1997. Other similar NP families which bind two protein domain targets include FK508 (FKBP and calcineurin), cyclosporines including cyclosporine A (cyclophilin and calcineurin), sanglifehrins including sanglifehrin A (cyclophilin and unknown target), FK520 (FKBP and calcineurin), meridamycin (FKBP and unknown target), antascomycin (FKBP and unknown target), nocardiopsins including nocardlopsin A (FKBP and unknown target) and catramycin (FKBP and unknown target).

We have discovered and describe a small molecule three-hybrid selection system which includes a library of cells producing different PKs and/or NRPs, each containing the same protein components of the three-hybrid selection system (for example, a DNA binding protein, a transcription activation protein and a reporter gene product or products), with a variable PKS or NRPS gene. This method can be used to select for cells producing PKs and/or NRPs which bind both a Retained binding domain for a protein (such as FKBP) and a Target domain for another protein (such as mTOR-FRAP).

SUMMARY OF THE INVENTION

The invention provides a method for generating a library of cells producing polyketides and selecting for cells which produce polyketides which bind to a target protein domain.

The invention also provides a method for generating hybrid polyketide synthases by using one or more of three recombination 'hotspots', and its use in either producing libraries of cells producing polyketides and cells producing specific polyketides or polyketide synthases.

The Invention also provides a cell transformed with a hybrid polyketide synthase and a three-hybrid selection system.

Definitions and Abbreviations

The articles "a" and "an" are used herein to refer to one or to more than one (I.e. at least one) of the grammatical objects of the article. By way of example "an analogue" means one analogue or more than one analogue.

As used herein the term "align" means to take one or more amino acid, DNA or RNA sequences and use a computer program, such as Clustal Omega to calculate homologous regions within the sequences and display them as adjacent lines of numbered amino acid, DNA or RNA sequence.

As used herein the term "analogue(s)" refers to chemical compounds that are structurally similar to another but which differ slightly in composition (as in the replacement of one atom by another or in the presence or absence of a particular functional group).

As used herein the term "strain(s)" refers to bacterial strains including, but not limited to, *Streptomyces rapamycinicus* NRRL 5491, *Streptomyces tsukubeensis*, *Streptomyces hygroscopicus* var *ascomyceticus* and their derivatives.

As used herein the term "polyketide synthase" or "PKS" refers to a protein with modular enzymatic activities which can lead to production of a polyketide, or mixed polyketide-non-ribosomal peptide under certain conditions. The PKSs referred to in this document exclusively refer to type 1 modular PKSs.

As used herein the term "non-ribosomal peptide synthetase" or "NRPS" refers to a protein with modular enzymatic activities which can lead to production of a non-ribosomal peptide. The NRPSs referred to in this document exclusively refer to modular NRPSs.

As used herein the term "polyketide" or "PK" refers to a polyketide or mixed polyketide-non-ribosomal peptide.

As used herein the term "Non-ribosomal peptide" or "NRP" refers to a non-ribosomal peptide.

The abbreviation "NP" means natural product and typically embraces a PK and an NRP.

The abbreviation "PK" means polyketide.

As used herein the term "AT domain" means an acyltransferase domain. AT domains typically have specificity for a particular extender unit. Possible substrates of AT domains include, but are not limited to, malonyl-CoA, methylmalonyl-CoA, ethylmalonyl-CoA, hydroxymalonyl-ACP or hydroxymalonyl-CoA, methoxymalonyl-ACP or methoxymalonyl-CoA, aminomalonyi-ACP or aminomalonyl-CoA, allylmalonyl-CoA or chloroethylmalonyl-CoA. In case of malonyl-CoA, a malonate unit is Incorporated into the growing NP chain. In case of methylmalonyl-CoA, a methylmalonate unit is incorporated into the growing NP chain. In case of ethymalonyl-CoA, an ethylmalonate unit is incorporated into the growing NP chain. In case of hydroxymalonyl-ACP or hydroxymalonyl-CoA, a hydroxymalonate unit is incorporated into the growing NP chain. In case of methoxymalonyl-ACP or methoxymalonyl-CoA, a methoxymalonate unit is incorporated into the growing NP chain. In case of aminomalonyl-ACP or aminomalonyl-CoA, an aminomalonate unit is incorporated into the growing NP chain. In case of allyimalonyl-CoA, an allylmalonate unit is incorporated into the growing NP chain. In case of chloroethylmalonyl-CoA, a chloroethylmalonate unit is incorporated into the growing NP chain. Other examples are known in the literature, such as described in Dunn and Khosla, 2013. In an NRPS, the Adenylation domain orA domain serves a similar purpose (see FIG. 12) and is interchangeable with AT with respect to this document. Thus the term "AT domain" embraces an A domain when referring to a NRPS. The specificity of an AT domain may be specified either by reference to the precursor (e.g. malonyl-CoA) or the substrate (e.g. malonate) (these references being equivalent).

As used herein the term "KS domain" means a ketosynthase domain. KS domains catalyse the condensation of precursors selected by the AT domain onto the nascent natural product covalently bound to an ACP domain. In an NRPS, the Condensation domain or C domain serves a similar purpose (see FIG. 12) and is interchangeable with KS with respect to this document. Thus the term "KS domain" embraces a C domain when referring to an NRPS.

As used herein the term "ACP domain" means acyl carder protein domain. ACP domains covalently bind the nascent natural product via a phosphopantetheine arm. In an NRPS, the Peptidyl Carrier Protein domain, also known as a thiolation domain or T or PCP domain serves a similar purpose (see FIG. 12) and is interchangeable with ACP with respect to this document. Thus the term "ACP domain" embraces a T domain when referring to an NRPS.

As used herein the term "nactivating" or "inactivated" refers to a gene from which the levels of gene product produced are significantly reduced.

As used herein the term "Retained binding domain" refers to one of the protein domains used in the three-hybrid selection system. This domain would typically bind to part of the polyketide product not being varied in the selection system, i.e. retained, such as an FKBP or cyclophilin protein domain and would be fused to either a DNA binding domain or a Transcription activation domain (see FIG. 10).

As used herein the term "three-hybrid selection system" refers to an artificial cell based selection system whose principle relies on binding interactions between three elements. Typically, the system is expressed in a cell where the interaction of two detector macromolecules (usually proteins) is promoted by a small molecule, which binds both macromolecules and joins them, leading to the direct or indirect synthesis (or down regulation) of one or more reporters. Examples of the detector macromolecules include FKBP and mTOR-FRAP, FKBP and calcineurin or cyclophilin and calcineurin. Examples of reporters include antibiotic resistance genes, products to complement auxotrophic pathways, or other products whose presence (or reduced presence or absence as a result of down regulation) which can be detected by various means, including but not limited to spectroscopy, Fluorescence activated cell sorting (FACS) or growth of a cel on a selective medium.

As used herein the term "accelerated evolution" refers to the previously described method for rapidly generating bacteria producing a diverse range of PKs and NRPs based on recombination (WO2015/004458 and examples herein, such as Example 19). This can be used to generate a library of cells producing a diverse array of PKs or NRPs.

As used herein the term "cell" or "cells" refers to a prokaryotic or eukaryotic cell. Preferentially this is bacterial. Most preferentially this is a cell which is capable of producing a PK or NRPS.

As used herein the term "Target domain" refers to one of the two protein domains used in the three-hybrid selection system. This domain would usually be varied, allowing for selection of cells producing polyketides which bind to the Target domain and would be fused to either a DNA binding domain or a Transcription activation domain (the other compared to the domain fused to the Retained binding domain) (see FIG. 10).

As used herein the term "DNA binding domain" refers to a protein domain which recognizes and binds to a selected DNA target (a recognition sequence).

As used herein the term "Transcription activation domain" refers to a protein domain which activates transcription of the reporter gene when the protein complex is bound to a recognition sequence upstream of the reporter gene.

As used herein the term "recognition sequence" in the context of a "recognition sequence for a DNA binding domain" refers to a DNA sequence that is capable of being recognised by and binding to a DNA binding domain.

As used herein the term "recognition sequence" in the context of a "restriction enzyme recognition sequence" (e.g. a "Bael recognition sequence") refers to a DNA sequence that is capable of being recognised by and binding to a restriction enzyme (e.g. Bael) leading to cleavage. Restriction enzymes typically cleave in the middle, beside or near their recognition sequence. For example, type IIS restriction enzymes such as Bael or Sapl cleave besides their recognition sequence.

As used herein the term "hybrid PKS" or "hybrid NRPS" (or similar expression, such as "hybrid modular NRPS") refers to a non-natural polyketide synthase or non-ribosomal peptide synthetase having one or more module deletions or insertions. Inserted modules may be from the same or a different PKS/NRPS.

As used herein the term "reporter gene" refers to a gene whose expression in a cell can be used as a basis for selection (including identification or separation) of that cell.

As used herein the term "module" refers to a section of a polyketide synthase or non-ribosomal peptide synthetase protein containing one or more domains, Involved in at least one round (typically one round) of chain extension or chain transfer (more commonly chain extension), including but not limited to a ketosynthase ("KS", ketoreductase ("KR"), dehydratase ("DH"), enoyl reductase ("ER"), acyl carrier protein ("ACP"), acyl transferase ("AT"), thioesterase ("TE"), condensation, thiolation, peptidyl carrier protein, methylation or adenylation domain.

As used herein the term "domain" refers to a section of a polyketide synthase or non-ribosomal peptide synthetase protein containing a single enzymatic activity, Including but not limited to a ketosynthase, ketoreductase, dehydratase, enoyl reductase, acyl carrier protein, acyl transferase, thioesterase, condensation, thiolation, peptidyl carrier protein, methylation or adenylation domain.

As used herein the term "pre-ACP domain region" means the region between the ACP domain and the domain preceding it in a gene, whatever that may be. Typically the domain preceding an ACP domain in a gene is a KR or AT domain.

As used herein the term "Junction region 1" refers to a region of a gene which codes for a type I modular polyketide synthase Ketosynthase which aligns on a multiple sequence alignment, such as Clustal Omega, with amino acids 199-342 of SEQ ID NO 37 and amino acids 203-348 of SEQ ID NO 38 (see FIG. 2, boxed region).

As used herein the term "Junction region 2" refers to a region of a gene which codes for a type I modular polyketide synthase Acyltransferase which aligns on a multiple sequence alignment, such as Clustal Omega, with amino adds 5-248 of SEQ ID NO 85 (which AT is specific for a malonyl CoA) or amino acids 5-289 of SEQ ID NO 88 (which AT is specific for a methyl malonyl CoA) (see FIG. 3, boxed region).

As used herein the term "Junction region 3"refers to a region of a gene which codes for an interdomain region in a type I modular polyketide synthase preceding the Acyl Carrier Protein (pre-ACP) which aligns on a multiple sequence alignment, such as Clustal Omega, with amino adds 184-268 of SEQ ID NO 39, amino acids 184-289 of SEQ ID NO 40 and amino acids 184-270 of SEQ ID NO 41 (see FIG. 4, boxed region).

As used herein the term "nucleic acid vector construct" means a nucleic acid vehicle, for example, a plasmid, suitable for conveying recombinant nucleic add into a host call.

As used herein the term "heterologous PKS" means a PKS which is not the PKS naturally produced by the host cell. The term "heterologous NRPS" may be interpreted in an analogous fashion.

As used herein the term "type 1 modular polyketide synthase" (or "type 1 modular PKS") means a polyketide synthase in which more than one module containing multiple enzymatic domains (usually made up of at least KS, AT and ACP on a single polypeptide) are used in the biosynthesis of a polyketide natural product, such as in the 8-deoxyerythronolide B synthase or rapamycin synthase.

As used herein the term "non-contiguous in nature" as used in the sentence "two sections of DNA encoding PKS genes or parts thereof which are non-contiguous in nature" means DNA which not joined (and therefore non-contiguous) in a wild type organism which naturally contains PKS genes.

As used herein in the context of performance of methods of the invention, the term "ex vivo" means performance outside of an organism such as a bacterium capable of generating a hybrid PKS or hybrid NRPS by processes involving DNA recombination.

Percentage identity determinations can be performed for nucleic acids using BLASTN or standard nucleotide BLAST using default settings (Match/Mismatch scores 1, −2) Gap costs linear, Expect threshold 10, Word size 28 and match matches in a query range 0) and for proteins using BLAST using default settings (Expect threshold 10, Word size 3, Max matches in a query range 0, Matrix Blosum62, Gap costs Existence 11, extension 1 and conditional compositional score matrix adjustment).

BRIEF DESCRIPTION OF THE DRAWINGS

FIGS. 1A and 11:

FIG. 1A: Assembly of plasmid pRR0*b* from fragments pRR0 (backbone), pRR01 (fragment 1), pRR07 (fragment 2), pRR02 (fragment 3), pRR03 (fragment 4), pRR04 (fragment 5) and pRR05 (fragment 6), containing a partial rapB gene that allows insertion of module-encoding sequences into Junction region 3. Fragments that can be introduced into the insertion point include (but are not limited to) rapamycin PKS module 8 (pDiv1-003), consisting of ACP7, KS8, AT8, DHB and KR8.

FIG. 1B: Assembly of pRR0*c* from fragments pRR0 (backbone), pRR06 (fragment 1), pRR02 (fragment 2), pRR03 (fragment 3), pRR04 (fragment 4) and pRR05 (fragment 5), containing a partial rapB gene that allows insertion of module-encoding sequences into Junction region 1. Fragments that can be introduced into the insertion point include (but are not limited to) rapamycin PKS module 8 (pDivi-003), consisting of a part of KS8, ATS, DH8, KR8, ACP8 and a part of KS9.

FIGS. 2A-2D: Alignment of rapamycin Ketosynthases (KSs), with Junction region 1 shown as a boxed region. The whole sequence shown in the Figure approximately corresponds to an entire KS domain. The amino acid sequences are RapKS14 (SEQ ID NO: 203); RapKS4 (SEQ ID: 204); RapKS7 (SEQ ID: 205); RapKS3 (SEQ ID: 206); RapKS6 (SEQ ID: 207); RapKS13 (SEQ ID: 208); RapKS11 (SEQ ID: 209); RapKS1 (SEQ ID: 210); RapKS10 (SEQ ID: 211); RapKS9 (SEQ ID: 212); RapKS5 (SEQ ID: 213); RapKS12 (SEQ ID: 214); RapKS2 (SEQ ID: 215); and RapKS8 (SEQ ID: 216).

FIGS. 3A-3C: Alignment of rapamycin Acyltransferases (ATs), with Junction region 2 shown as a boxed region. The whole sequence shown in the Figure approximately corresponds to an entire AT domain. The amino acid sequences are AT1 (SEQ ID: 217); AT7 (SEQ ID: 218); AT10 (SEQ ID: 219); AT4 (SEQ ID: 220); AT6 (SEQ ID: 221); AT3 (SEQ ID: 222); AT13 (SEQ ID: 223); AT14 (SEQ ID: 224); AT5 (SEQ ID: 225); AT9 (SEQ ID: 228); AT2 (SEQ ID: 227); AT8 (SEQ ID: 228); AT11 (SEQ ID: 229); and AT12 (SEQ ID: 230).

FIGS. 4A-4C: Alignment of rapamycin pre-ACP domain regions, with Junction region 3 shown as a boxed region. The whole sequence shown In the Figure approximately corresponds to an entire KR domain, the pre-ACP domain region and an entire ACP domain. The amino acid sequences are KR-ACP13 (SEQ ID NO: 231); KR-ACP8 (SEQ ID NO: 232); KR-ACP3 (SEQ ID NO: 233); KR-ACP5 (SEQ ID NO: 234); KR-ACP10 (SEQ ID NO: 235); KR-ACP8 (SEQ ID NO: 236); KR-ACP1 (SEQ ID NO: 237); KR-ACP7 (SEQ ID NO: 238); KR-ACP12 (SEQ ID NO: 239); KR-ACP2 (SEQ ID NO: 240); KR-ACP11 (SEQ ID NO: 241); KR-ACP4 (SEQ ID NO: 242); and KR-ACP9 (SEQ ID NO: 243).

FIGS. 6A-6C: Figure showing example insertion of sequence coding for PKS domains from one PKS gene into another PKS gene using each of the three Junction regions to create hybrid PKS genes.

FIGS. 7A-7C:

FIG. 7A: Assembly of plasmids pDJA17 and pDJA23. pDJA17 is comprised of fragments pRR0 (backbone), pRR01 (fragment 1), pDJA10 (fragment 2), pRR02 (fragment 3), pRR03 (fragment 4), pRR04 (fragment 5) and pRR05 (fragment 6), containing a partial rapB gene that allows insertion of native module-encoding sequences into Junction region 1 at the insertion point. Fragments that can be introduced into the insertion point include (but are not limited to) rapamycdn PKS native module 6 (pDJA20) and 12 (pDJA22), consisting of KS6, AT6, DH6, KR6, ACP8 and KS7, and KS12, AT12, DH12, KR12, ACP12 and KS13, respectively. pDJA23 is comprised of fragments pRR0 (backbone), pRR01 (fragment 1), pDJA11 (fragment 2), pRR02 (fragment 3), pRR03 (fragment 4), pRR04 (fragment 5) and pRR05 (fragment 8), containing a partial rapB gene that allows insertion of non-native module-encoding sequences into Junction region 1 at the insertion point. Fragments that can be introduced into the insertion point include (but are not limited to) rapamycin PKS non-native module 8 (pDJA25) and 12 (pDJA27), consisting of KS6, AT6, DH6, KR6, ACP6 and KS7, and KS12, AT12, DH12, KR12, ACP12 and KS13, respectively.

FIG. 7B: Alignment of 64 bp within KS Junction region 1 found at the ends of native module encoding fragments and the insertion point of pDJA17. The nucleotide sequences are KS12 (SEQ ID NO: 244); KS8 (SEQ ID NO: 245); KS13 (SEQ ID NO: 246); KS7 (SEQ ID NO: 247); and KS8 (SEQ ID NO: 248).

FIG. 7C: Alignment of 64 bp within KS Junction region 1 found at the ends of non-native module encoding fragments and the insertion point of pDJA23. The 64 bp region found in KS6 Junction region 1 of the insertion point of pDJA23 and module 6 is comprised of native sequence (KS6n). Bases shown in capital letters correspond to silent introduced base changes with respect to native sequence. The nucleotide sequences are KS8 (SEQ ID NO: 249); KS13 (SEQ ID NO: 250); KSBn (SEQ ID NO: 251); KS7 (SEQ ID NO: 252); and KS12 (SEQ ID NO: 253).

FIG. 8A: Example of the generation of a library of diverse PKS-encoding genes by utilising 2 different inserts: rapamycin module 8 (1), which utilises a malonate extender and contains a KR and DH domain, and rapamycin module 6 (2), which utilises a methylmalonate extender and contains no active reductive domains.

FIG. 8B: Theoretical chemical diversity created by combinations of modules shown in FIG. 8A.

FIGS. 11A-11F:

FIGS. 11A-11D: overview of Rapamycin genes and their role in rapamycin chain extension FIG. 11E: overview of library generation in which a host cell having a missing or inactive rapB gene is complemented by a variable rapB gene FIG. 11F: overview of the concept of selecting for rapamycin analogues that have a common FKBP binding portion but variable ability to bind the effector (mTOR-FRAP).

FIG. 12A: A Pictorial representation of a typical PKS module with core Ketosynthase (KS), Acyl Transferase (AT), Acyl Carrier Protein (ACP) domains and optional Ketoreductase (KR), Enoyl Transferase (ER) and Dehydratase (DH) domains.

FIG. 12B: Pictorial representation of a typical NRPS module with core Condensation (C), Adenylation (A), Thiolation or Peptidyl Carrier Protein (T) domains and optional Epimerization (E) and Methylation (M) domains.

FIGS. 14A-14C: A pictorial representation of the rapA and rapB PKS genes in the bacterial strains containing productive hybrid rapamycin PKS along with yields of rapamycin analogue in each case in μM. "H" indicates hybrid module (see also FIG. 15 and Example 18).

FIGS. 15A-15KK: Sequence alignment showing specific junctions in a selection of mutant rapamycin and tylosin analogue producing strains. A representative image of the gene arrangement in the hybrid PKS genes is shown above the alignment in each case, genes are displayed as arrows, with the tip of the arrow denoting the end of the gene. The amino acid sequences are: FIG. 15A: ISOM-4139-SEQ ID NO: 254; ISOM-4139 Module 3-SEQ ID NO 255, ISOM-4139 Module 13-SEQ ID NO: 256; FIG. 15B: ISOM-4139 ISOM-4139-SEQ ID NO: 257; ISOM-4139 Module 13 (lower panel)-SEQ ID NO: 258; ISOM-4139 Module 3 (lower panel)-SEQ ID NO: 259; FIG. 15C: ISOM-4141-SEQ ID NO: 260; ISOM-4141 Module 3-SEQ ID NO: 281; ISOM-4141 Module 4-SEQ ID NO: 262; FIG. 15D: ISOM-4142-SEQ ID NO: 263; ISOM-4142 Module 3-SEQ ID NO: 264; ISOM-4142 Module 6-SEQ ID NO: 265; FIG. 15E: ISOM-4144-SEQ ID NO: 266; ISOM-4144 Module 2-SEQ ID NO: 267; ISOM-4144 Module 4-SEQ ID NO: 268; FIG. 15F: ISOM-4148-SEQ ID NO: 269; ISOM-4146 Module 3-SEQ ID NO: 270; ISOM-4148 Module 6-SEQ DI NO: 271; FIG. 15G: ISOM-4172-SEQ ID NO: 272; ISOM-4172 Module 3-SEQ ID NO: 273; ISOM-4172 Module 6-SEQ ID NO: 274; FIG. 15H: ISOM-4176-SEQ ID NO: 275; ISOM-4176 Module 6-SEQ ID NO: 276; ISOM-4176 Module 7-SEQ ID NO: 277; FIG. 15I: ISOM-4178-SEQ ID NO: 278; ISOM-4178 Module 3-SEQ ID NO: 279; ISOM-4178 Module 7-SEQ ID NO: 280; FIG. 15J: ISOM-4180-SEQ ID NO: 281; ISOM-4180 Module 2-SEQ ID NO: 282; ISOM-4180 Module 8-SEQ ID NO: 283; FIG. 15K ISOM-4184-SEQ ID NO: 284; ISOM-4184 Module 2-SEQ ID NO: 285; ISOM-4184 Module 8-SEQ ID NO: 286; FIG. 15L ISOM-4185-SEQ ID NO: 287; ISOM-4185 Module 3-SEQ ID NO: 288; ISOM-4185 Module 6-SEQ ID NO: 289; FIG. 15M: ISOM-4187-SEQ ID NO: 290; ISOM-4187 Module 1-SEQ ID NO: 291; ISOM-4187 Module 7-SEQ ID NO: 292; FIG. 15N: ISOM-4192-SEQ ID NO: 293; ISOM-4192 Module 2-SEQ ID NO: 294; ISOM-4192 Module 5-SEQ ID NO: 295; FIG. 15O: ISOM-4193-SEQ ID NO: 298; ISOM-4193 Module 2-SEQ ID NO: 297; ISOM-4193 Module 8-SEQ ID NO: 298; FIG. 15P: ISOM-4279 (above dotted line)-SEQ ID NO: 299; ISOM-4279 Module 2-SEQ ID NO: 300; ISOM-4279 Module 3-SEQ ID NO: 301; ISOM-4279 (below dotted line)-SEQ ID NO: 302; ISOM-4279 Module 4-SEQ ID NO: 303; ISOM-4279 Module 7-SEQ ID NO: 304; FIG. 15Q: ISOM-4280-SEQ ID NO: 305; ISOM-4280 Module 2-SEQ ID NO: 308; ISOM-4280 Module 3-SEQ ID NO: 307; FIG. 15R: ISOM-4291-SEQ ID NO: 308; ISOM-4291 Module 2-SEQ ID NO: 309; ISOM-4291 Module 3-SEQ ID NO. 310; FIG. 15S: ISOM-4359-SEQ ID NO: 311; ISOM-4359 Module 1-SEQ ID NO: 312; ISOM-4359 Module 6-SEQ ID NO: 313; FIG. 15T: ISOM-4867-SEQ ID NO: 314; ISOM-4867 Module 2-SEQ ID NO: 315; ISOM-4867 Module 11-SEQ ID NO: 316; FIGS. 15V and 15W: ISOM-4854-SEQ ID NO: 320; ISOM-4854 Module 4-SEQ ID NO: 321; ISOM-4854 Module 6-SEQ ID NO: 322; FIGS. 15X and 15Y: ISOM-4855-SEQ ID NO: 323;

ISOM-4855 Module 4-SEQ ID NO: 324; ISOM-4855 Module 6-SEQ ID NO: 325; FIG. 15Z and 15AA: ISOM-4897-SEQ ID NO: 326; ISOM-4897 Module 4-SEQ ID NO: 327; ISOM-4897 Module 6-SEQ ID NO: 328; FIG. 15CC: ISOM-5004-SEQ ID NO: 329; ISOM-5004 Module 1-SEQ ID NO: 330; ISOM-5004 Module 4-SEQ ID NO: 331; FIG. 15DD and 15EE: ISOM-5005-SEQ ID NO: 332; ISOM-5005 Module 4-SEQ ID NO: 333; ISOM-5005 Module 6-SEQ ID NO: 334; FIG. 15FF: ISOM-5008-SEQ ID NO: 335; ISOM-5008 Module 1-SEQ ID NO: 336; ISOM-5008 Module 4-SEQ ID NO: 337; FIG. 15GG: ISOM-5009-SEQ ID NO: 338; ISOM-5009 Module 2-SEQ ID NO: 339; ISOM-5008 Module 6-SEQ ID NO: 340; FIG. 15HH: ISOM-5010-SEQ ID NO: 341; ISOM-5010 Module 2-SEQ ID NO: 342; ISOM-5010 Module 6-SEQ ID NO: 343; FIGS. 1511 and 15JJ: ISOM-5051-SEQ ID NO: 344; ISOM-5051 Module 0-SEQ ID NO: 345; ISOM-5051 Module 6-SEQ ID NO: 348; FIG. 15KK: ISOM-5054-SEQ ID NO: 347; ISOM-5054 Module 2-SEQ ID NO: 348; ISOM-5054 Module 6-SEQ ID NO: 349.

FIGS. 16A-16B: A pictorial representation of PKS genes in the bacterial strains containing hybrid tylosin PKS. "H" Indicates hybrid module (see also FIG. 15 and Example 18).

DESCRIPTION OF THE INVENTION

Figure 5:
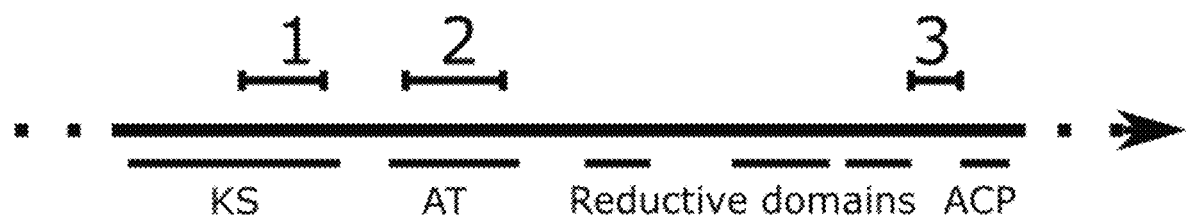
FIG. 5: Diagram of relative locations of Junction regions 1, 2 and 3. Note that reductive domains are not always present, hence Junction region 3 refers to a part of the interdomain region preceding the Acyl Carrier Protein domain between the ACP domain and the preceding domain whatever it is.

The present invention provides methods for generating a library of cells producing polyketides and then selecting for cells producing polyketides which activate a three-hybrid selection system.

The invention provides a cell containing genetic information coding for both a functional polyketide synthase and a selection system (such as a reporter gene and/or an antibiotic resistance gene) which is activated if the Retained binding domain and transcription activation domain are joined by a polyketide.

Natural Product Libraries

By analysing the junctions of productive polyketide synthase genes generated by the methods described in WO2015/004458, the inventors have found that when the junction site is at a position in a specific region of the ketosynthase of one module and a corresponding position in the same region of the ketosynthase of another module (Junction region 1) or a position in a specific region of the acyltransferase of one module, and a corresponding position in the same region of the acyltransferase of another module (preferably where the acyltransferase has the same specificity (e.g. for malonyl CoA or methylmalonyl CoA) (Junction region 2) or a position in a specific region preceding the acyl carrier protein of one module and a corresponding position in the same region preceding the acyl carrier protein of another module (Junction region 3), then the productivity of the resulting polyketide synthase is more consistently high.

A junction site so identified can facilitate deletion of one or more modules such that the junction is made between the specific region of one module and the corresponding region of the module which immediately follows the deletion.

A junction site so identified can also be used to join a series of one or more modules, such that the junction is made between the specific region of each module of the series. This is used in the generation of libraries as discussed in the examples.

Two junction sites so identified can facilitate insertion of one or more modules such that the first junction is made between the specific region of one module into which an insert is made and the corresponding region of the first module of the insert and the second Junction is made between the specific region of the last module of the insert and the corresponding region of the module into which the insert is made.

This information can be used to design productive modular polyketide synthase genes, encoding combinations of enzymatic activities with the potential to generate a diverse range of chemistry, depending on which modules (and their enzymatic domains) are included and in what order.

It should be noted that, although the sequences defining Junction Regions 1, 2 and 3 are specific sequences from rapamycin genes, due to the sequence identity that exists between corresponding sequences of other KS domains, AT domains and pre-ACP domain regions of rapamycin genes in general and of other PKSs and NRPSs, the method of the invention is widely applicable.

Generic Junction Design

Figure 6A:
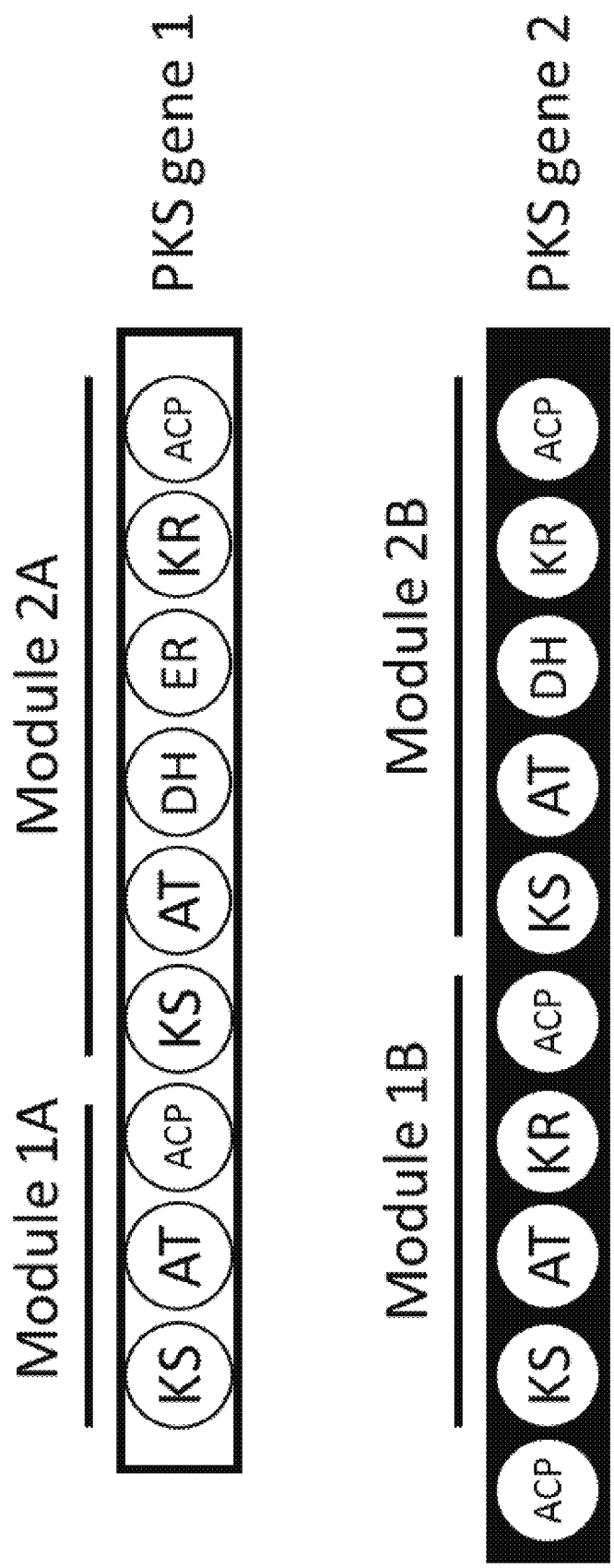

A general method for designing hybrid polyketide synthases using the productive recombination hotspots as follows and an example of module insertion is shown in FIG. 6: Design of module junctions at Junction region 1 (KS to KS)

Design of hybrid junctions between sequences encoding different PKS modules using Junction region 1 (KS to KS) can be done using the generic procedure outlined below. Access to annotated sequence information of polyketide biosynthesis clusters that encode the module that performs the desired chain extension and processing chemistry is available via many routes, including, but not limited to analysis by antiSMASH 3.0 (Weber, T. et al., 2015): antismash.secondarymetabolites.org/.

Figure 2A:
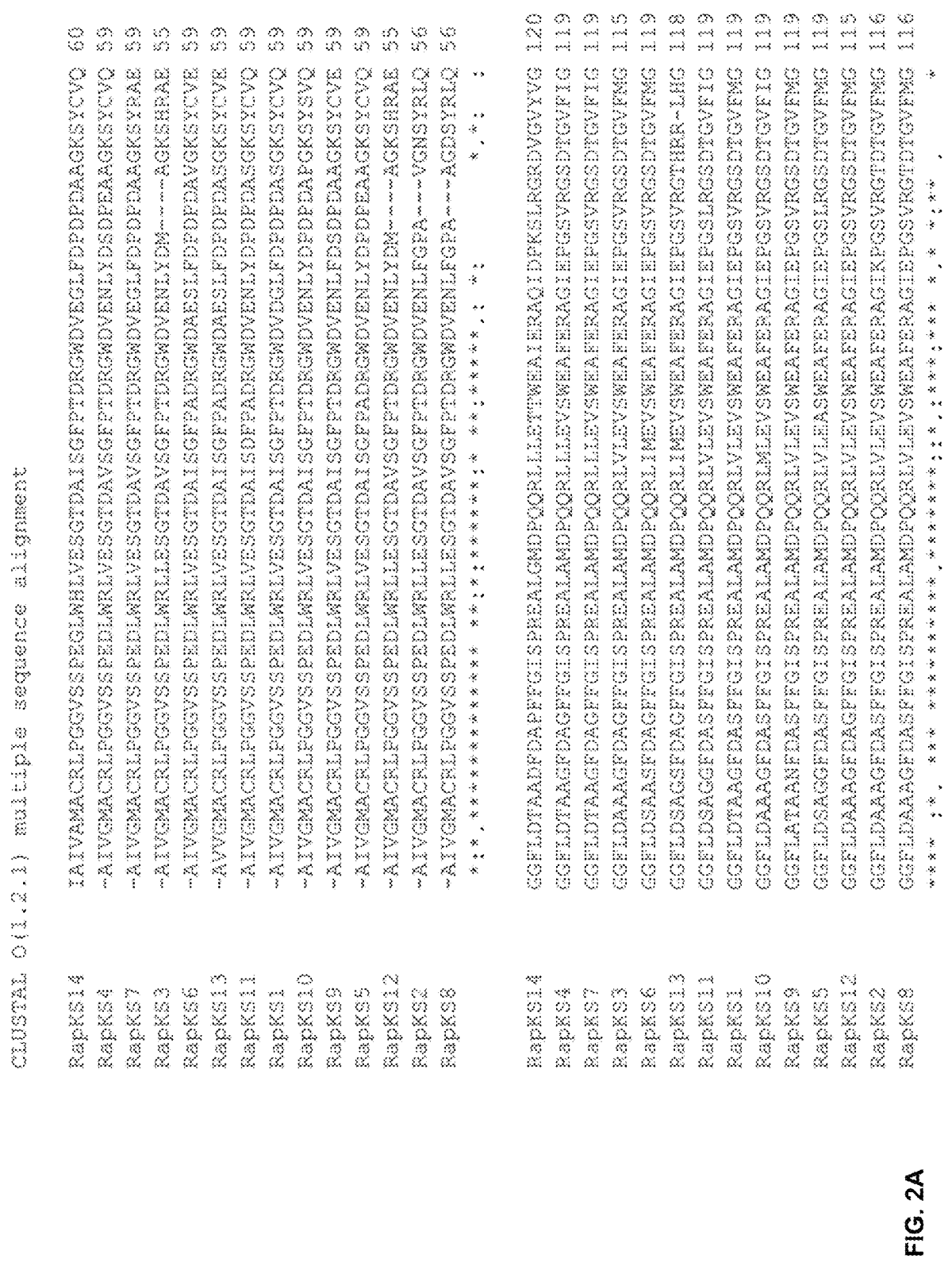

In order to identify the correct location of the junction site in a KS domain, a multiple sequence alignment, for example using CLUSTAL Omega (Wilm et al., 2011): ebi.ac.uk/Tools/msa/clustalo/) is performed using SEQ ID NO 37 and SEQ ID NO 38 (which are the amino acid sequences of rapamycin $KS_3$ and rapamycin $KS_6$) and the amino acid sequences of $KS_n$ and $KS_{n+1}$, where $KS_n$ is the KS domain to the left of the junction and $KS_{n+1}$ is the KS domain to the right of the junction. The junction site to be used between $KS_n$ and $KS_{n+1}$ is chosen at a position in a region within those residues of the amino acid sequences of said KS~and $KS_{n+1}$ that are aligned with amino acids 199-342 of SEQ ID NO 37 (shown as boxed region in FIG. 2) as well as amino acids 203-346 of SEQ ID NO 38 (shown as boxed region in FIG. 2).

The inventors have found that a reliable junction determination is possible by performing an alignment with two KS domain sequences, this being more reliable than aligning with a single KS module sequence.

Figure 2B:
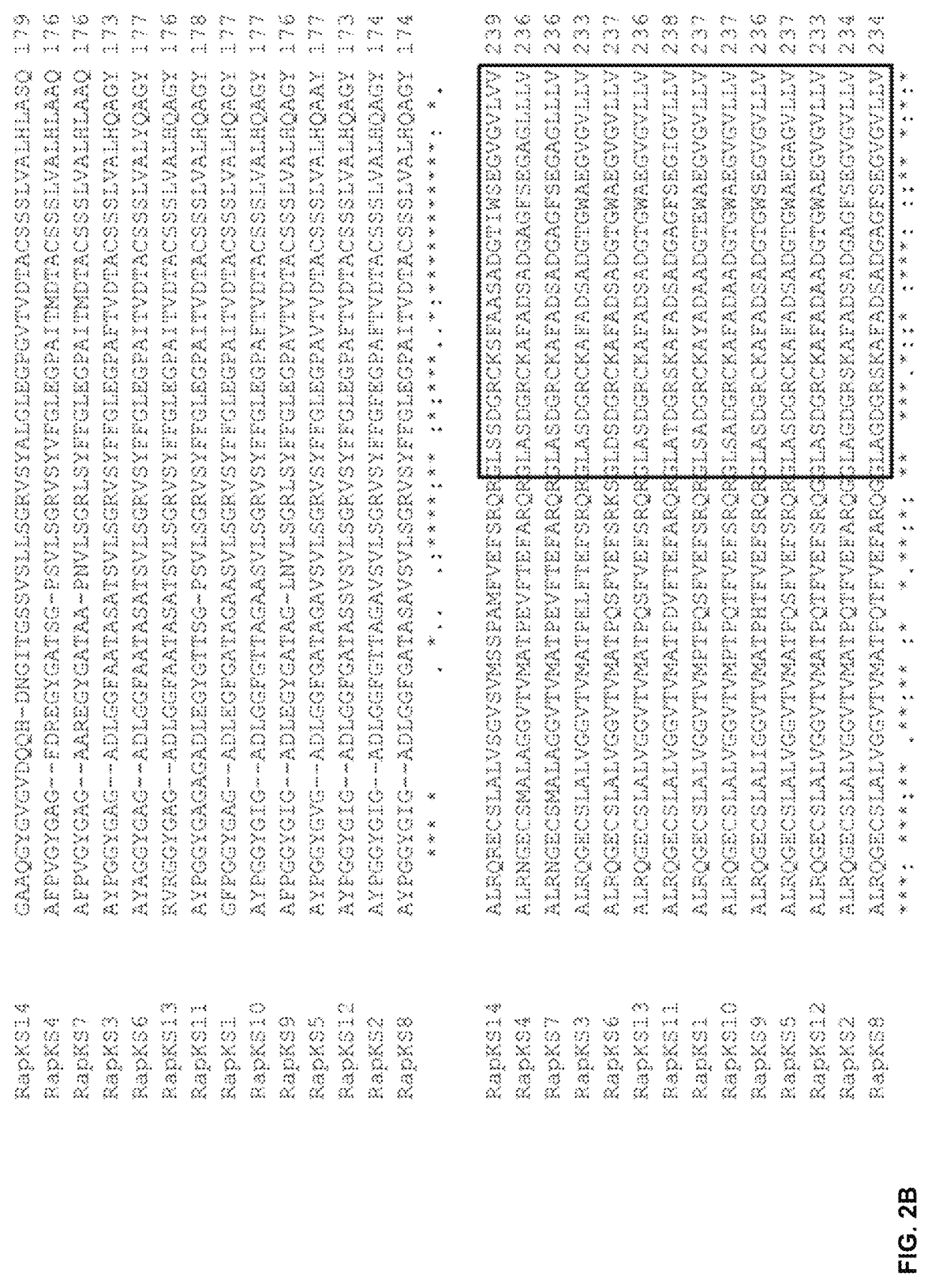
Figure 2C:
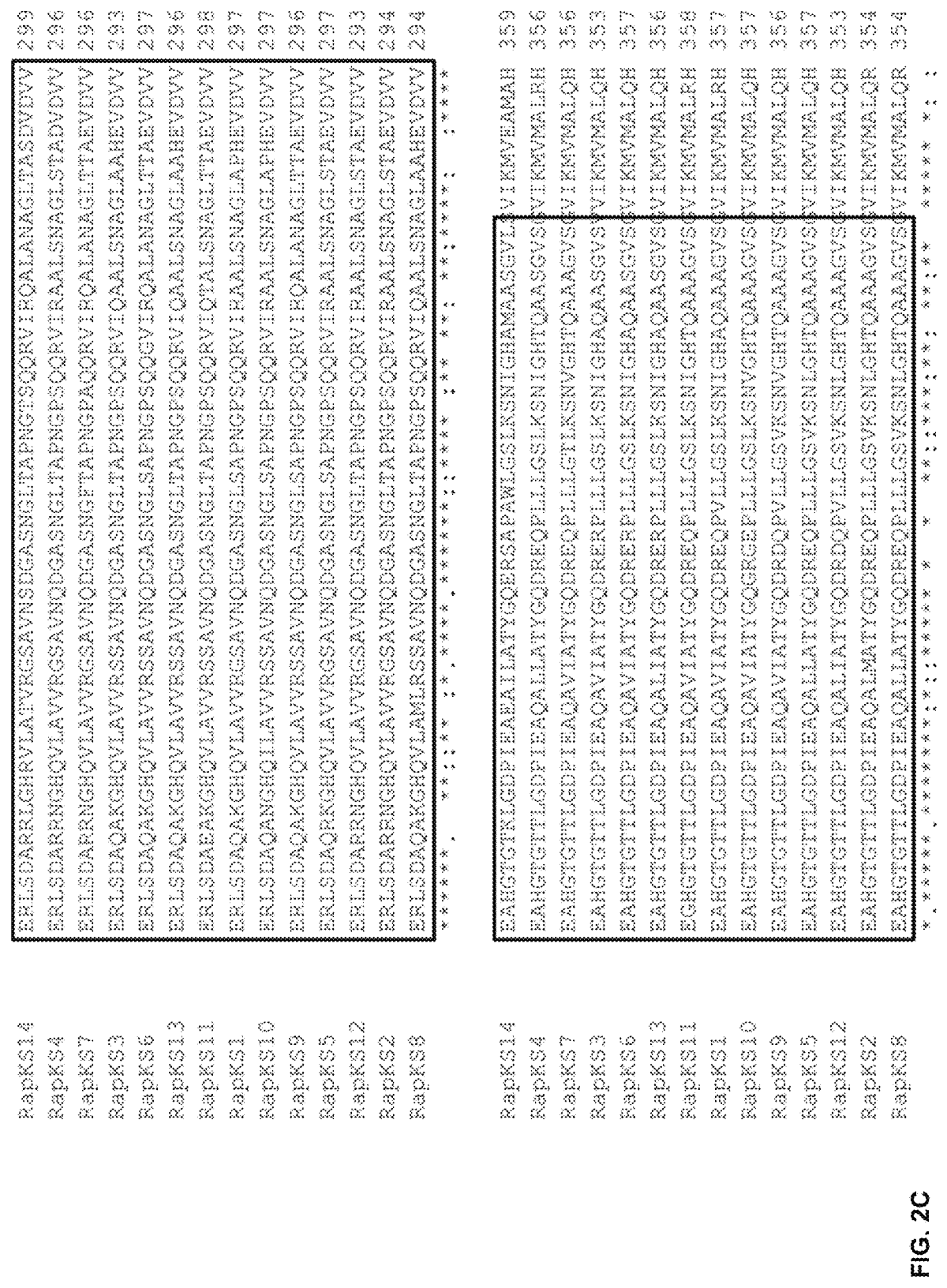

Suitably the junction site further aligns with 1, 2, 3, 4, 5, 6, 7, 8, 9, 10, 11 or 12 other rapamycin KS domain sequences shown in FIG. 2 within the boxed region.

Figure 14B:
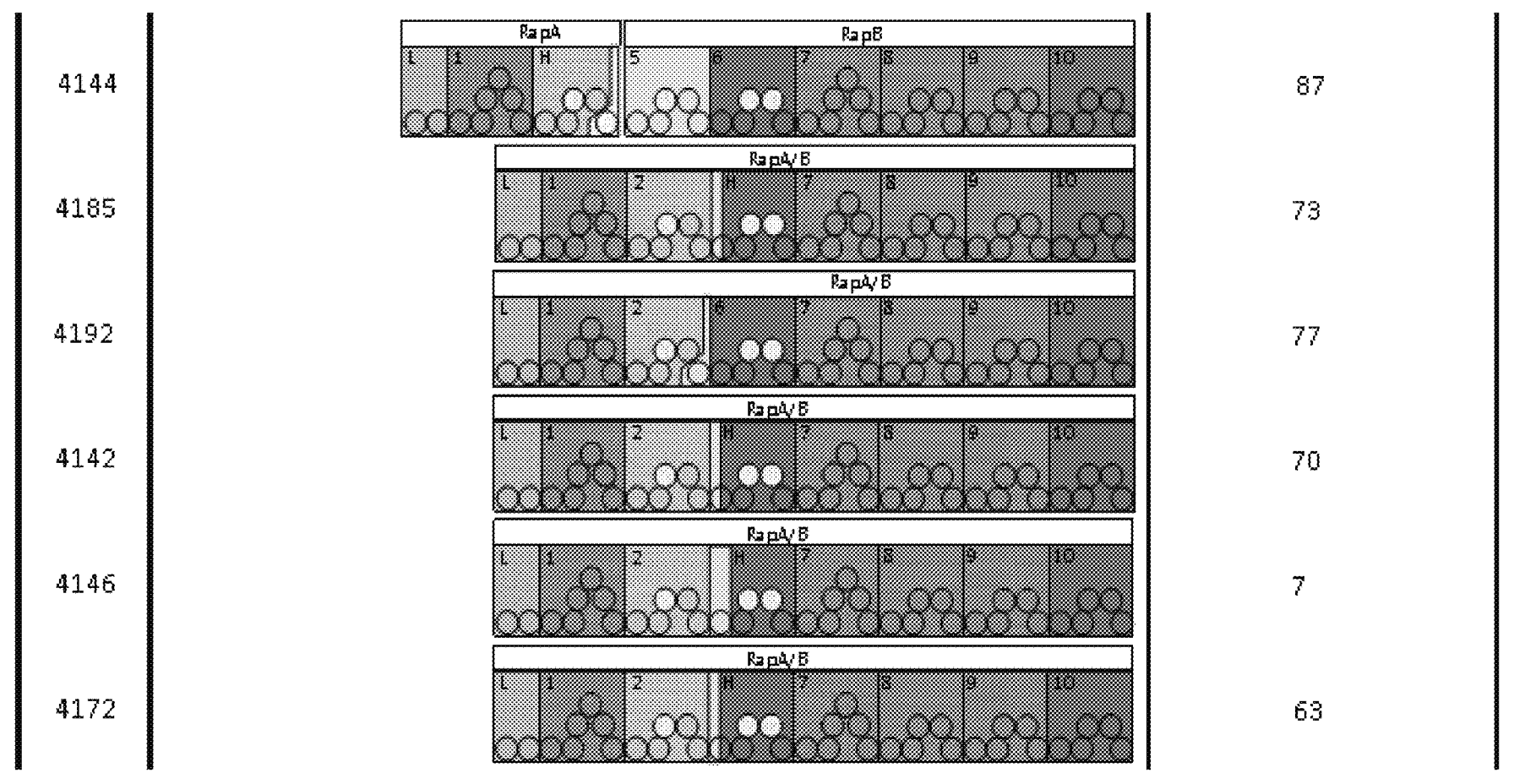
Figure 14C:
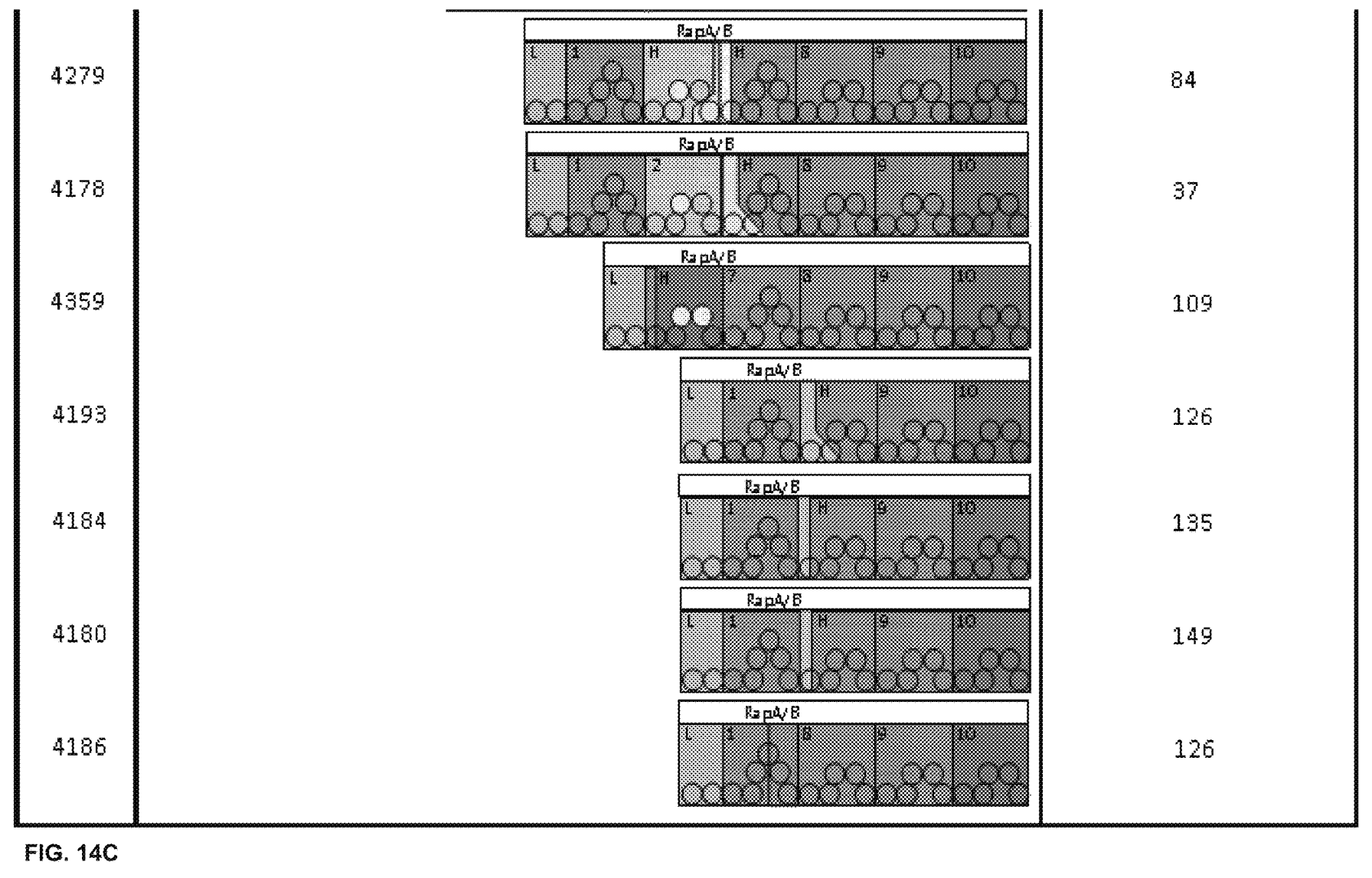
Figure 16A:
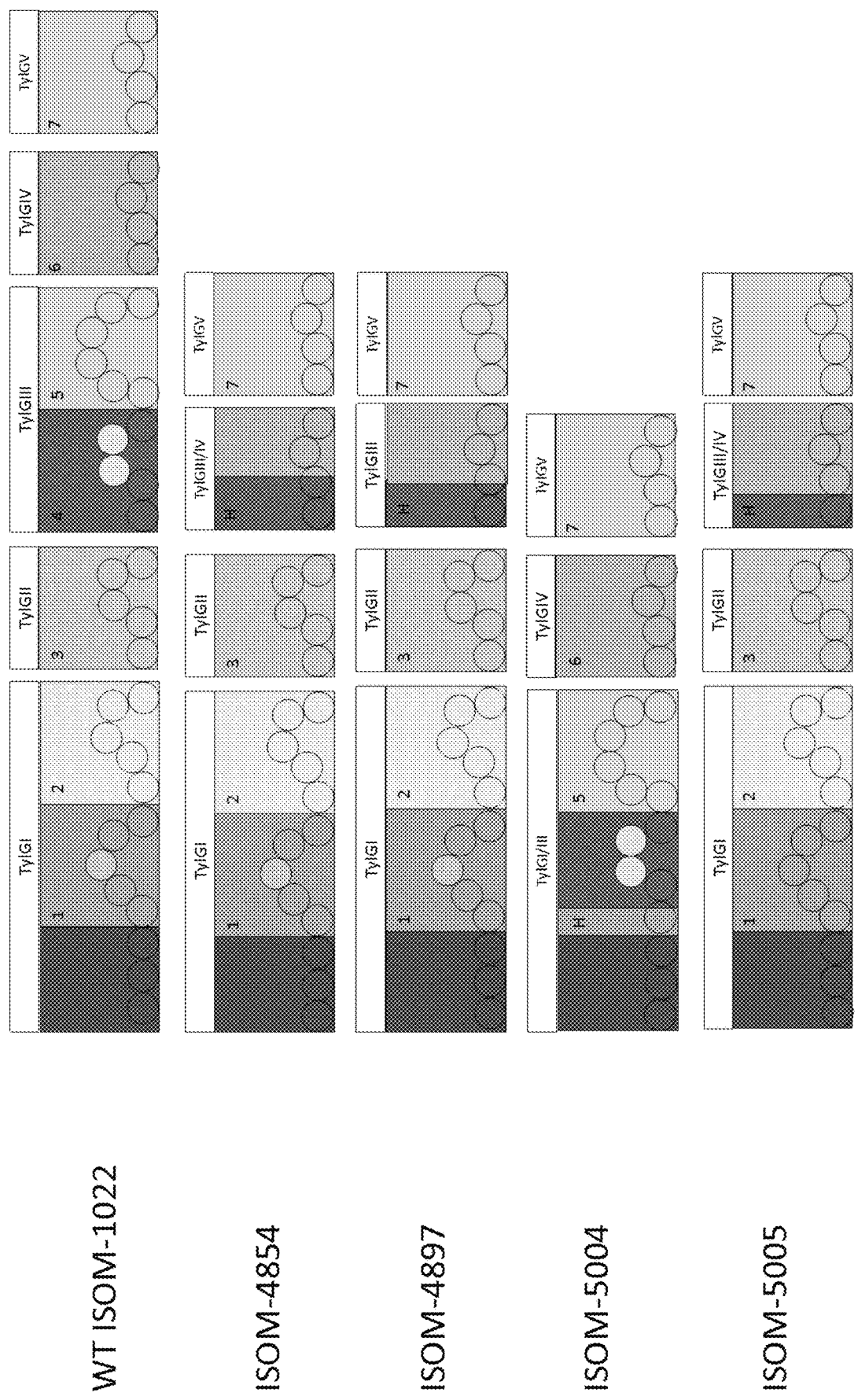

The inventors have found that a reliable junction determination within a KS domain is possible in a wide range of hybrid PKS genes of a type 1 modular PKS and not limited to rapamycin PKS genes (see e.g. Example 18 and FIGS. 14, 15 and 16).

Preferably, the junction site is chosen within a region of identity between $KS_n$ and $KS_{n+1}$, being a region of at least 2, preferably at least 6, more preferably at least 10, more preferably at least 16, yet more preferably at least 20 identical contiguous amino acids. Preferably, the junction site is chosen at position flanked on either side by a region of identity between $KS_n$ and $KS_{n+1}$, such as a region of at least 1, preferably at least 3, preferably at least 5, more preferably at least 8, yet more preferably 10 identical contiguous amino acids. The coding strands of the nucleotide sequence encoding the amino acids of module n up to the junction site and the nucleotide sequence encoding the amino acid sequences of module n+1 starting at the junction site are joined, resulting in a sequence encoding two modules joined at Junction region 1.

Design of Module Junctions at Junction Region 2 (AT to AT)

Design of hybrid junctions between sequences encoding different PKS modules using Junction region 2 (AT to AT) can be done using the generic procedure outlined below. Preferably the join is made between ATs with the same or similar specificity (e.g. methyl malonate AT to methyl malonate AT or malonate AT to malonate AT). Access to annotated sequence information of polyketide biosynthesis clusters that encode the module that performs the desired chain extension and processing chemistry is available via many routes, including, but not limited to analysis by antiSMASH 3.0 (Weber, T. et al., 2015): antismash.secondarymetabolites.org/.

In order to identify the correct location of the junction site in a AT domain, a multiple sequence alignment, for example using CLUSTAL Omega (Wilm et al., 2011): ebi.ac.uk/Tools/msa/clustalo/) is performed using SEQ ID NO 85 or SEQ ID NO 86 (which are the amino acid sequences of rapamycin AT2 and rapamycin AT8, respectively being specific for malonyl CoA and methylmalonyl CoA) and the amino acid sequences of $AT_n$ and $AT_{n+1}$, where $AT_n$ is the AT domain to the left of the junction and $AT_{n+1}$ is the AT domain to the right of the junction. The junction site to be used between $AT_n$ and $AT_{n+1}$ is chosen at a position in a region within those residues of the amino acid sequences of said $AT_n$ and $AT_{n+1}$ that are aligned with amino acids 5-246 of SEQ ID NO 85 (shown as boxed region in FIG. 3) or amino acids 5-269 of SEQ ID NO 86 (shown as boxed region in FIG. 3).

Figure 3B:
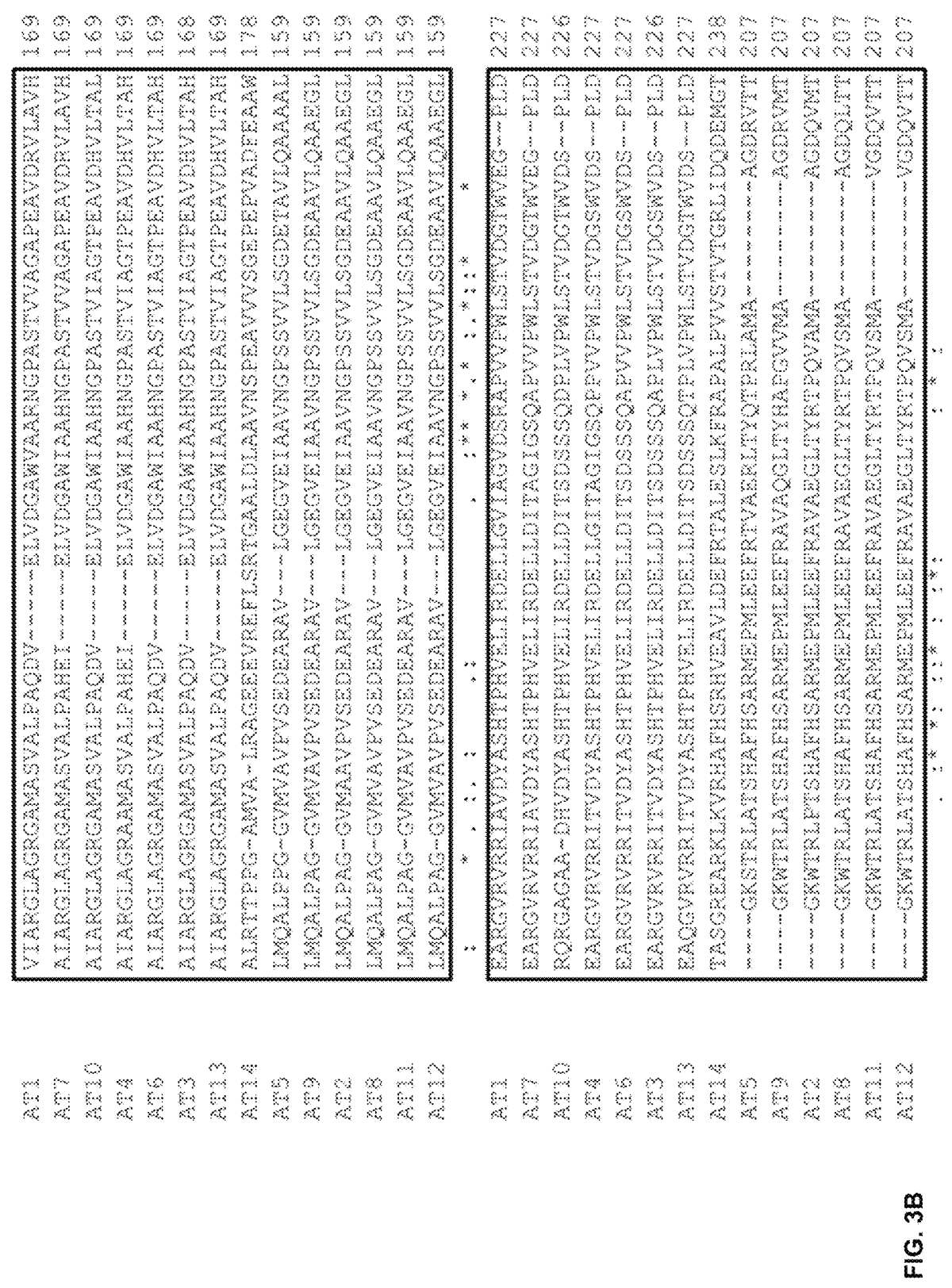

Suitably the junction site further aligns with 1, 2, 3, 4 or 5 or more other rapamycin AT domain sequences shown in FIG. 3 within the boxed region.

The Inventors have found that a reliable junction determination within an AT domain is possible in a wide range of hybrid PKS genes of a type 1 modular PKS and not limited to rapamycin PKS genes (see e.g. Example 18 and FIGS. 14, 15 and 16).

Preferably, the junction site is chosen in a region of identity between $AT_n$ and $AT_{n+1}$, being a region of at least 2, preferably at least 6, more preferably at least 10, more preferably at least 16, yet more preferably at least 20 identical contiguous amino acids. Preferably, the junction site is chosen at position flanked on either side by a region identity between $AT_n$ and $AT_{n+1}$, such as a region of at least 1, preferably at least 3, preferably at least 5, more preferably at least 8, yet more preferably 10 Identical contiguous amino acids. The coding strands of the nucleotide sequence encoding the amino acids of module n up to the junction site and the nucleotide sequence encoding the amino acid sequences of module n+1 starting at the junction site are joined, resulting in a sequence encoding two modules joined at Junction region 1.

Design of module junctions at Junction region 3 (pre-ACP to peACP) Design of hybrid junctions between sequences encoding different PKS modules using Junction region 3 (pre-ACP domain region to pre-ACP domain region) can be done using the generic procedure outlined below. Access to annotated sequence information of polyketide biosynthesis clusters that encode the module that performs the desired chain extension and processing chemistry is available via many routes, Including, but not limited to analysis by antiSMASH 3.0 (Weber, T. et al., 2015): antismash.secondarymetabolites.org/.

In order to identify the correct location of the junction site, a multiple sequence alignment, using CLUSTAL Omega (Wilm et al., 2011): ebi.ac.uk/Tools/msa/cdustalol) Is performed using SEQ ID NO 39, SEQ ID NO 40 and SEQ ID NO 41 (which are the amino acid sequences of rapamycin pre-ACP and ACP domains of modules 2, 3 and 4, respectively) and the comparable amino acid sequences of pre-$ACP_n$ and pre-$ACP_{n+1}$, where pre-$ACP_n$ is the pre-ACP domain region to the left of the junction and pre-$ACP_{n+1}$ is the pre-ACP domain region to the right of the junction. The junction site to be used between pre-$ACP_n$ and pre-$ACP_{n+1}$ is chosen at a position in a region within those residues of the amino acid sequences of said pre-$ACP_n$ and pre-$ACP_{n+1}$ domains that are aligned with amino adds 184-268 of SEQ ID NO 39 (shown as boxed region in FIG. 4), amino acids 184-289 of SEQ ID NO 40 (shown as boxed region in FIG. 4) and amino adds 184-270 of SEQ ID NO 41 (shown as boxed region in FIG. 4).

The inventors have found that a reliable junction determination is possible by performing an alignment with three pre-ACP domain region sequences, this being more reliable than aligning with one or two pre-ACP domain region sequences.

The Inventors have found that a reliable junction determination within a pre-ACP domain region is possible in a wide range of hybrid PKS genes of a type 1 modular PKS and not limited to rapamycin PKS genes.

Figure 4B:
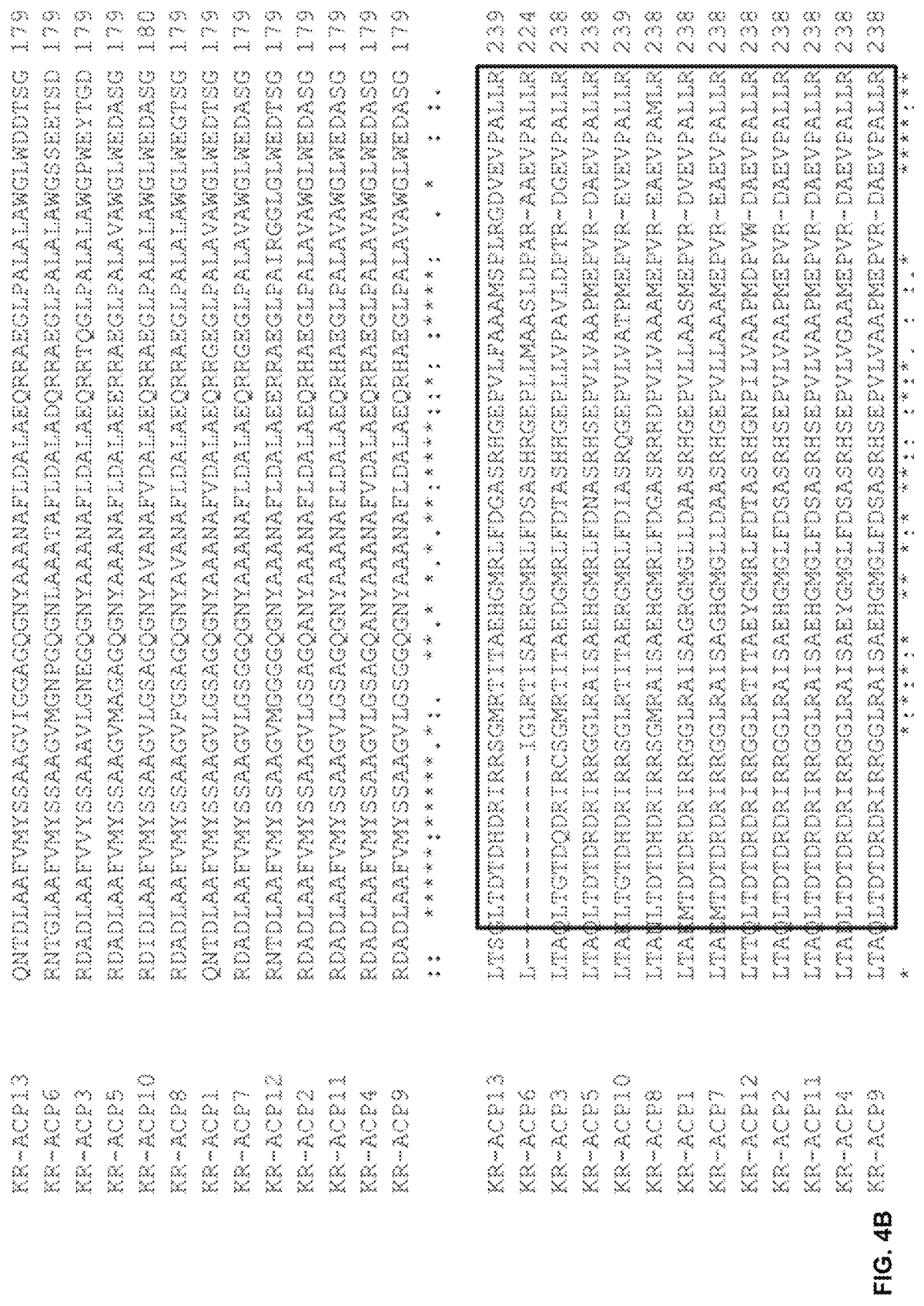

Suitably the junction site further aligns with 1, 2, 3, 4, 5, 6, 7, 8, 9, or 10 other rapamycin pre-ACP domain region sequences shown In FIG. 4 within the boxed region.

Preferably, the junction site is chosen in a region of identity between pre-$ACP_n$ and pre-$ACP_{n+1}$, being a region of at least 2, preferably at least 8, more preferably at least 10, more preferably at least 18, yet more preferably at least 20 identical contiguous amino acids.

Preferably, the junction site is chosen at position flanked on either side by a region identity between pre-$ACP_n$ and pre-$ACP_{n+1}$, such as a region of at least 1, preferably at least 3, preferably at least 5, more preferably at least 8, yet more preferably 10 identical contiguous amino acids. The coding strands of the nucleotide sequence encoding the amino acids of module n up to the junction site and the nucleotide sequence encoding the amino acid sequences of module n+1 starting at the junction site are joined, resulting in a sequence encoding two modules joined at Junction region 3.

Thus the invention provides a method for producing a hybrid PKS gene of a type 1 modular PKS or a hybrid modular NRPS gene in which one or more modules are deleted or inserted which comprises joining two sections of DNA encoding a PKS gene or part thereof which are non-contiguous in nature and creating the junction between said sections of DNA (a) within DNA encoding a KS domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 as well as amino acids 203-346 of SEQ ID NO 38; or (b) within DNA encoding an AT domain so that two AT domains $AT_n$ and $AT_{n+1}$ are joined at a position in a region within those residues of the amino acid sequences of said KS and $KS_{n+1}$ that are aligned with amino acids 5-246 of SEQ ID NO 85 or amino acids 5-269 of SEQ ID NO 86 or (c) in DNA encoding the inter-domain region before the ACP domain so that two pre-ACP domain regions pre-$ACP_n$ and pre-$ACP_{n+1}$ are joined at a position in a region within those residues of the amino acid sequences of said pre-$ACP_n$ and pre-$ACP_{n+1}$ domains that are aligned with amino acids 184-268 of SEQ ID NO 39, amino acids 184-269 of SEQ ID NO 40 and amino acids 184-270 of SEQ ID NO 41.

The Invention further provides a method for producing a hybrid PKS gene of a type 1 modular PKS or a hybrid modular NRPS gene in which one or more modules are deleted or inserted which comprises creating a junction (a) within a KS domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 (shown as boxed region in FIG. 2) as well as amino acids 203-346 of SEQ ID NO 38 (shown as boxed region in FIG. 2); or (b) within an AT domain so that two AT domains $AT_n$ and $AT_{n+1}$ are joined at a position in a region within those residues of the amino acid sequences of said $KS_n$ and $KS_{n+1}$ that are aligned with amino acids 5-248 of SEQ ID NO 85 (shown as boxed region in FIG. 3) or amino acids 5-289 of SEQ ID NO 88 (shown as boxed region in FIG. 3) or (c) in the inter-domain region before the ACP domain so that two pre-ACP domain regions pre-$ACP_n$ and pre-$ACP_{n+1}$ are joined at a position in a region within those residues of the amino acid sequences of said pre-$ACP_n$ and pre-$ACP_{n+1}$ domains that are aligned with amino acids 184-268 of SEQ ID NO 39 (shown as boxed region in FIG. 4), amino acids 184-289 of SEQ ID NO 40 (shown as boxed region in FIG. 4) and amino acids 184-270 of SEQ ID NO 41 (shown as boxed region in FIG. 4).

Thus, in an embodiment, a method is provided for producing a hybrid PKS gene of a type 1 modular PKS or a hybrid modular NRPS gene in which one or more modules are deleted or inserted which comprises creating a junction (a) within a KS domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 as well as amino acids 203-348 of SEQ ID NO 38. Suitably the position is in a region within those residues of the amino acid sequences of said $KS_n$ and $KS_{n+1}$ that are aligned with amino acids 199-260 or 266-276 or 289-342 of SEQ ID NO 37 or amino acids 203-264 or 270-280 or 293-348 of SEQ ID NO 38.

In another embodiment, a method is provided for producing a hybrid PKS gene of a type 1 modular PKS or a hybrid modular NRPS gene in which one or more modules are deleted or inserted which comprises creating a junction (b) within an AT domain so that two AT domains $AT_n$ and $AT_{n+1}$ are joined at a position in a region within those residues of the amino acid sequences of said $KS_n$ and $KS_{n+1}$ that are aligned with amino acids 5-248 of SEQ ID NO 85 or amino acids 5-289 of SEQ ID NO 86. $AT_n$ and $AT_{n+1}$ are AT domains having the same specificity (e.g. both for malonyl CoA or both for methyimalonyl CoA). Suitably the position is in a region within those residues of the amino acid sequences of said $AT_n$ and $AT_{n+1}$ that are aligned with amino acids 5-17 or 43-123 or 232-247 of SEQ ID NO 85 or amino acids 5-17 or 54-135 or 243-270 of SEQ ID NO 88.

In another embodiment, a method is provided for producing a hybrid PKS gene of a type 1 modular PKS or a hybrid modular NRPS gene in which one or more modules are deleted or inserted which comprises creating a junction (c) in the inter-domain region before the ACP domain so that two pre-ACP domain regions pre-$ACP_n$ and pre-$ACP_{n+1}$ are joined at a position in a region within those residues of the amino acid sequences of said pre-$ACP_n$ and pre-$ACP_{n+1}$ domains that are aligned with amino acids 184-268 of SEQ ID NO 39, amino acids 184-289 of SEQ ID NO 40 and amino acids 184-270 of SEQ ID NO 41. Suitably the position is in a region within those residues of the amino acid sequences of said pre-$ACP_n$ and pre-$ACP_{n+1}$ domains that are aligned with amino acids 184-215 or 255-288 of SEQ ID NO 39 or amino acids 184-215 or 258-289 of SEQ ID NO 40 or amino acids 184-215 or 257-270 of SEQ ID NO 41.

In an embodiment the method is a method for producing a hybrid PKS gene of a type 1 modular PKS. In an embodiment the method is a method for producing a hybrid PKS gene of a type 1 modular PKS which can leads to production of a PK. In an embodiment the method is a method for producing a hybrid PKS gene of a type 1 modular PKS which can lead to production of a mixed PK-NRP. Alternatively the method is a method for producing a hybrid NRPS.

The method may involve joining three sections of DNA encoding PKS genes or parts thereof no pair of which is non-contiguous in nature thereby to create two junctions.

The aforementioned methods are, for example, in silico methods. Alternatively they may be performed ex vivo.

The aforementioned methods may be performed in a non-bacterial host cell, such as a fungal cell particularly a yeast cell especially wherein the yeast is Saccharomyces cerevisiae.

The Invention provides a nucleic acid vector construct may be prepared which comprises a hybrid PKS gene of a type 1 modular PKS or a hybrid NRPS gene produced as described above. The vector construct will typically contain other regulatory elements (promoters etc) allowing the gene to be expressed in a host cell into which it is transformed. Suitably the vector integrates (and preferably stably integrates) into the host genome. The nucleic acid vector construct is suitably DNA especially double stranded DNA such as a plasmid (especially a double stranded DNA plasmid).

The invention also provides a nucleic acid vector construct which comprises a hybrid PKS gene of a type 1 modular PKS or a hybrid modular NRPS gene in which one or more modules are deleted or inserted which comprises a junction (a) within (e.g. within DNA encoding) a KS domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 (shown as boxed region in FIG. 2) as well as amino acids 203-348 of SEQ ID NO 38 (shown as boxed region In FIG. 2); or (b) within (e.g. within DNA encoding) an AT domain so that two AT domains $AT_n$ and $AT_{n+1}$ are joined at a position in a region within those residues of the amino acid sequences of said $AT_n$ and $AT_{n+1}$ that are aligned with amino acids 5-248 of SEQ ID NO 85 (shown as boxed region in FIG. 3) or amino acids 5-289 of SEQ ID NO 88 (shown as boxed region in FIG. 3) or (c) just before (e.g.just before DNA encoding) the ACP domain so that two pre-ACP domain regions pre-ACP and pre-ACP$_{n+1}$ are joined at a position in a region within those residues of the amino acid sequences of said pre-ACP$_n$ and pre-ACP$_{n+1}$ domains that are aligned with amino acids 184-288 of SEQ ID NO 39 (shown as boxed region in FIG. 4), amino acids 184-289 of SEQ ID NO 40 (shown as boxed region in FIG. 4) and amino acids 184-270 of SEQ ID NO 41(shown as boxed region in FIG. 4).

The invention provides a cell which may be transformed with such a nucleic acid vector construct. In an embodiment, the cell is a PK or NRP producing host (such as an actinomycete) in which one or more PKS or NRPS genes has been deleted or inactivated. The or each corresponding deleted/inactivated gene can be replaced in mutated form with a gene conveyed on a nucleic acid vector construct (e.g. a plasmid) with which the cell is transformed. Thus, in effect, a gene In the transforming DNA complements a missing or defective gene in the host cell. For example the host cell expresses a rapamycin PKS with a missing or inactive rapB gene (i.e. a rapamycin PKS with a missing or inactive rapB gene is contained in the host cell genome). A replacement (mutant) rapB gene may be provided on the nucleic acid vector construct (e.g. plasmid) with which the host cell is transformed. Alternatively the cell is not PK or NRP producing (e.g. E. coli) and all the PK and NRPS genes are provided e.g. on one or more plasmids. Alternatively the cell is PK or NRP producing (e.g. an actinomycete) however all the PKS or NRPS genes are deleted or inactivated and are replaced (e.g. carried on a nucleic acid vector construct such as a plasmid) by the genes of a heterologous PKS or NRPS. One or more of the genes may be mutated as described herein.

Examples cells, PKSs and NRPSs are described below in the section headed "Three-Hybrid Selection System"

The Invention provides a process for producing an NP selected from a PK and a NRP which comprises culturing a PK or NRP producing cell in which one or more genes of the PKS or NRPS are mutated as described herein. Suitably the cell is transformed with a nucleic acid vector construct which comprises one or more mutant PKS or NRPS genes. PK and NRP molecules may be isolated after production.

Cells that produce a desired NP may be selected using the three-hybrid selection method described herein.

In a preferred embodiment the hybrid gene is a hybrid PKS gene of a type 1 modular PKS in particular a type 1 modular PKS which can lead to production of a PK or alternatively can lead to production of a mixed PK-NRP. For example the hybrid PKS gene is a hybrid rapamycin PKS gene or a hybrid tylosin PKS gene.

Alternatively the hybrid gene is a hybrid NRPS gene.

Bael Generic Design

The regions outlined above are used to design a hybrid PKS, the encoding DNA of which can be generated either by DNA synthesis or by other methods detailed in this document For example, generation of a PKS-encoding gene with two modules fused at the KS using the Bael-based system described in example 1.

Bael is a type IIS restriction enzyme. Use of a Bael-based system (or use of type IIS systems in general) is advantageous since no residue of the restriction site remains after the hybrid PKS has been formed.

To enable this, in addition to the procedure outlined above, the sequences of module n and module n+1 are searched for any Beel recognition sequences (ACNNNNGTAYC, where Y is C or T). Any Beel recognition sequences are removed by introducing silent mutations in them. Following this, the module sequences are trimmed such that the sequence of module n stops at the chosen junction site and the sequence of module n+1 starts at the chosen junction site. The sequence Bael1 (SEQ ID NO 87) is then copied to the end of the sequence of module n, where NNNNN is replaced with the first 5 nucleotides of module n+1, which adds the Beel recognition sequence (underlined) to the module sequence and ensures the Beel enzyme cuts the DNA at the correct location. The sequence Bael2 (SEQ ID NO 88) is then copied to the start of the sequence of module n+1, which adds the Beal recognition sequence to the module sequence and ensures the Beel enzyme cuts the DNA at the correct location. Following digestion with Beel, these DNA fragments can be ligated together ensuring an in-frame fusion of the two modules at the chosen junction site.

This method can be used to insert modules by utilising junctions to the left and right of the module to be inserted. Most preferably the junctions utilise the same hotspot on either side of the insert.

It will be appreciated that the method above may be adapted to use recognition sequences of other type IIS restriction enzymes besides Bael. Other type IIS restriction enzymes that could be used (which have different overhangs and recognition sequnces) include, but are not limited to Fokl, Alwl, Bsal, Bbsl, BsmBl, Sapl and Esp3l.

It will be appreciated that the method above may be adapted to use counter selection markers flanked by the Bael recognition sequences or other type IIS restriction enzyme recognition sequences, including but not limited to those mentioned above, in order to improve the efficiency of library generation. Examples of counter selection markers include, but are not limited to, the ocdB toxin gene (Bernard, P. 1995) and antisense RNA targeting of the mqsA antitoxin gene (Tsukuda, M. et al., 2015).

This method can also be used to design PKS genes containing multiple junction points. Again, the method above can be used to design each junction point Most preferably the junctions utilise the same hotspot for every junction.

Yeast Recombination Generic Design 1

The regions outlined above are used to design a hybrid PKS, the encoding DNA of which can be generated either by DNA synthesis or by other methods detailed in this document For example, to generate a PKS-encoding gene with two modules fused at the KS using yeast homologous recombination and native PKS sequence as described in Example 2.

To enable this, in addition to the procedure outlined above, the sequence of module n ends at a chosen position and the sequence of module n+1 starts at a chosen position such that the two modules share overlapping homology within Junction region 1 up to and including the entire Junction region 1 (see FIG. 2). Saccharomyces cerevisiae is able to recombine modules n and n+1 using regions of identity present in the junction regions chosen.

This method can be used to insert modules by utilising junctions to the left and right of the module to be inserted. Most preferably the junctions utilise the same hotspot on either side of the insert.

This method can also be used to design PKS genes containing multiple junction points. Again, the method above can be used to design each junction point Most preferably the junctions utilise the same hotspot for every junction.

Yeast Recombination Generic Design 2

The regions outlined above are used to design a hybrid PKS, the encoding DNA of which can be generated either by DNA synthesis or by other methods detailed in this document. For example, to generate a PKS-encoding gene with two or more modules fused at the KS using yeast homologous recombination and non-native PKS sequence as described in Example 3. This design of yeast recombination is, in some cases, preferable to that of yeast recombination design 1 since it facilitates the introduction of two or more inserts with predictable relative order.

To enable this, in addition to the procedure outlined above, the sequence of module n ends at a chosen position and the sequence of module n+1 starts at a chosen position such that the two modules share overlapping homology within Junction region 1 up to and including the entire Junction region 1 (see FIG. 2). Similarly, the sequence of module n+1 ends at a chosen position and the sequence of module n+2 starts at a chosen position such that the two modules share overlapping homology within Junction region 1 up to and including the entire Junction region 1. *Saccharomyces cerevisiae* is able to recombine modules n, n+1 and n+2 using regions of identity present in the junction regions chosen at the ends of the modules. Single base changes (that are silent at the amino acid level) in the overlapping junction regions at the end of module n and the start of module n+1 are introduced in the same positions. Similarly, silent base changes are also introduced in the overlapping junction regions of modules n+1 and n+2 in the same fashion. The changes made are such that regions of unique identity between the overlap regions of modules n and n+1 are created (see KS7 and KS12 in FIG. 7C) and also unique identity between the overlap regions of modules n+1 and n+2 are created (see KS8 and KS13 in FIG. 7C).

This method can be used to insert modules by utilising junctions to the left and right of the module to be inserted. Most preferably the junctions utilise the same hotspot on either side of the insert.

This method can also be used to design PKS genes containing multiple junction points. Again, the method above can be used to design each junction point Most preferably the junctions utilise the same hotspot for every junction.

Figure 9:
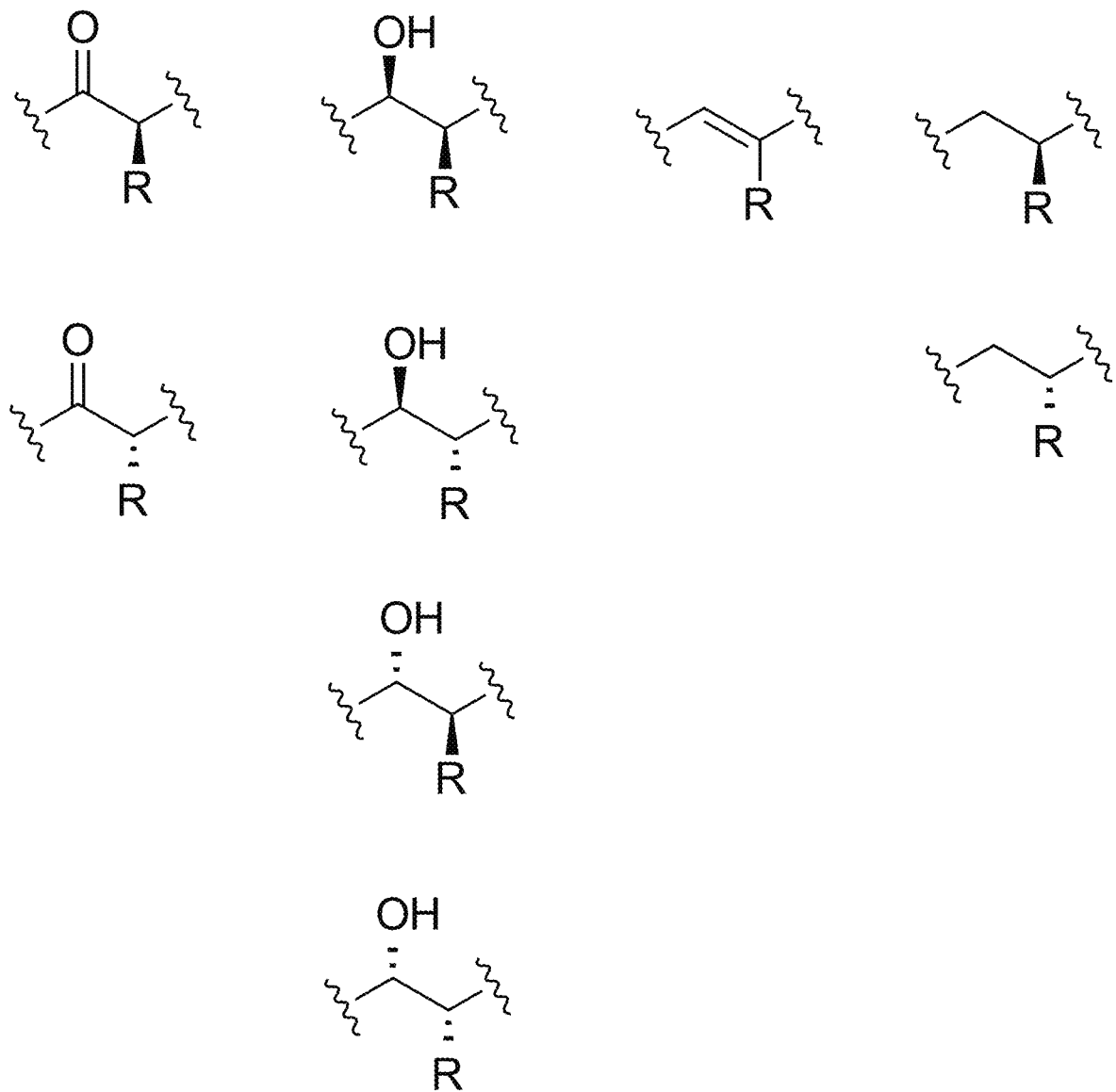
FIG. 9: A list of example chemistry that can be generated using PKS modules containing different enzymatic domains. R can be Hydrogen, methyl, ethyl, or one of a series of other more unusual extenders (see Dunn & Khosla 2013 and Chan at al., 2009).

The library of cells producing different PKs is potentially vast. Using the rapamycin system as an example, RapB contains 6 modules. FIG. 9 shows a non-exhaustive list of potential chemistry that can be obtained by using different modules. By utilising malonyl CoA and methyl malonyl CoA substituents alone (R=H or R=CH3), there are 14 options. Therefore the potential size of library with 1, 2, 3, 4, 5 or 6 modules in rapB, each containing one of the 14 options is 8,108,730 potential variants.

Three-Hybrid Selection System

In a broad aspect, the invention provides a cell which expresses or produces three elements of a three-hybrid selection system comprising: first and second elements which are proteins and a third element which is a natural product selected from polyketides and non-ribosomal proteins, wherein the first and second elements can bind the third element and wherein simultaneous binding of the first and second elements to the third element leads to a detectable change in the cell.

The detectable change may, for example, be regulation (e.g. activation) of transcription of a reporter gene. The detectable change may, for example, be production of an intact reporter the existence or activity of which can be detected.

It is to be understood that first and second elements which are proteins may comprise RNA i.e. they may be protein-RNA complexes.

Typically the first element comprises two domains, one of which is capable of binding the third element Typically the second element comprises two domains, one of which is capable of binding the third element. Typically the operation of the other domains of the first and second elements (i.e. the one other than the one binding the third element) leads to transcriptional regulation of the reporter gene. The first and second elements may optionally comprise a third or further domain. Typically the first and second elements are artificial proteins formed by fusion of the two (or more) domains.

Such a cell may be produced by transforming a host cell with one or more nucleic acid vector constructs (such as plasmids) which together encode the first and second elements and which encode the said reporter gene.

Optionally, the host cell may also be transformed with one or more nucleic acid vector constructs (such as plasmids) which encode some or all of the genes involved in biosynthesis of a polyketides or a non-ribosomal protein. The cell may not within its genome contain any such genes in which case all such genes can be provided on one or more nucleic acid vector constructs (such as plasmids). The cell may within its genome contain such genes (or some of such genes, but not a complete set) in which case none or some or all such genes can be provided on one or more nucleic acid vector constructs (such as plasmids).

Transcriptional regulation of the reporter gene may involve upregulation (i.e. activation of transcription) or downregulation (i.e. repression of transcription) of a reporter gene. The increased or reduced presence of a reporter gene product can be detected. More usually the transcriptional regulation of the reporter gene will involve upregulation of a reporter gene.

Transcriptional regulation of the reporter gene may be direct or indirect. As an example of indirect regulation, the simultaneous binding of the first and second elements to the third element may lead to upregulation of an amplifier which can increase expression of a reporter gene.

Further, it will be understood that the cells may be capable of expressing more than one reporter gene (for example two or more reporter genes) such that simultaneous binding of the first and second elements to the third element leads to transcriptional regulation of more than one reporter gene (for example two or more reporter genes). As noted below, this has the advantage that it allows for reduction of false positives due to mutation of the reporter gene promoter or else provides choice as regards the method of detection.

In an embodiment the first element is protein comprising a DNA binding domain such as FKBP or cyclophilin. In an embodiment the second element is a protein comprising a transcriptional regulation domain such as mTOR-FRAP or calcineurin.

In an embodiment, the first element comprises a FKBP domain which is an example of what is sometimes referred to herein as a Retained binding domain. In an embodiment, the first element comprises a cyclophilin domain (an alternative Retained binding domain). In an embodiment the second element comprises a domain selected from a mTOR-FRAP domain and a calcineurin domain, these being examples of what are sometimes referred to herein as Target domains. Other example Target domains are discussed below.

In a specific aspect, such a cell is provided wherein;
(i) the first element is a protein comprising a DNA binding domain which can recognise a DNA sequence upstream of the reporter gene and a domain which can bind said natural product; and
(ii) the second element is a protein comprising a transcriptional regulation domain which is capable of regulating the transcription of the reporter gene and a domain which can bind said natural product wherein simultaneous binding of the first and second elements to the third element leads to regulation of transcription of the reporter gene.

A further aspect of the invention relates to a library comprising two or more such cells which two or more cells each express or produce identical first and second elements and different third elements. Yet further aspects relate to a library comprising 10 or more, 50 or more, 100 or more, or 1000 or more cells which 10 or more, 50 or more, 100 or more, or 1000 or more cells each express or produce identical first and second elements and different third elements.

The Invention also provides a process for preparing such a cell or library of cells which comprises transforming a cell or strain of cells with a nucleic add vector construct or set of nucleic acid constructs (such as plasmids) which together encode the first and second elements and the reporter gene such that a natural product is produced. Such cells or strain of cells may also be transformed with one or more nucleic acid vector constructs which encode PKS or NRPS genes or parts of them (e.g. parts that encode one or more domains or modules). In an embodiment, the cells or strain of cells contain PKS or NRPS genes prior to transformation. In an embodiment, the cells or strain of cells do not contain PKS or NRPS genes prior to transformation.

Cells that produce PK or NRP molecules that simultaneously bind the first and second elements of the three-hybrid selection system can be identified due to transcriptional regulation of said reporter gene..

In an alternative embodiment of the invention there are provided cells wherein simultaneous binding of the first and second elements to the third element leads to a protein splicing event which produces a reporter the existence or activity of which can be detected (herein referred to sometimes as "the splicing embodiment"). According to this embodiment, the reporter is generated directly, instead of transcription of a reporter gene being activated. The reporter may for example be a visible marker or may confer antibiotic resistance. Other possible reporters are described elsewhere herein.

In such a cell the first and second elements each comprise a fragment (i.e. N and C terminal fragments) of a splicing enzyme and a fragments of the reporter such that simultaneous binding of the first and second elements to the third element leads to splicing of the fragments of the reporter thereby to produce an intact reporter the existence or activity of which can be detected.

The splicing enzyme may for example be selected from VMA protein from *Saccharomyces cerevisiae* (VDE) (Ozawa et al., 2000, Ozawa et al., 2001), HINT superfamily, bacterial intein-like domains (BILs) (Amital, 2002), Tac VMA intein, SufB inteln of *Mycobacterium tuberculosis* (Topilina, 2015), Cne-AD PRPB from *Aspergillus fumigatus* FRRO183 (Uu et al., 2004, Butler et al., 2005), CIV RIR1 from *Chilo* iridescent virus (Pietrokovski 1998, *Amital* 2004, Jakob 2001), Ceu CIpP from *Chlamydomonas* eugametos (Huang 1994, *Perier* 1997, Dalgaard 1997), Tli Pol-2 from *Acanthomoeba polyphaga* Mimivirus (Raoutt 2004, Ogata 2005), any other inteins included in InBase intein database (Perder et al., 2002), their homologues, or similar proteins.

Nucleic acid encoding the fragments of the splicing enzyme should desirably be codon optimised for the cell.

The cells of the invention may be cultured in an environment whereby multiple PK or NRP molecules are or might be synthesised by the cells. The cells may be cultured in an environment whereby PK or NRP molecules are produced having a structure which is potentially predictable (e.g. as expected from a particular PKS or NRPS and taking account of feedstocks (including starter acids) although it might not be known if non-natural feed stocks will be accepted by the PKS/NRPS. The cells may also be cultured in an environment whereby PK or NRP molecules are produced having a structure which is completely unpredictable, for example where the PKS or NRPS is mutated through induced recombination events. See for example technology described in VY02015/004458 (Isomerase Therapeutics Ltd) the contents of which are herein incorporated by reference in their entirety.

Thus cells of the library may produce PK or NRPS molecules that are the same as each other or different. Where they produce different PK or NRPS molecules these are potentially diverse in structure.

The first and second elements of the three-hybrid selection system may be selected to identify PK or NRP molecules produced by cells of the library according to their ability to bind to said elements.

Figure 10:
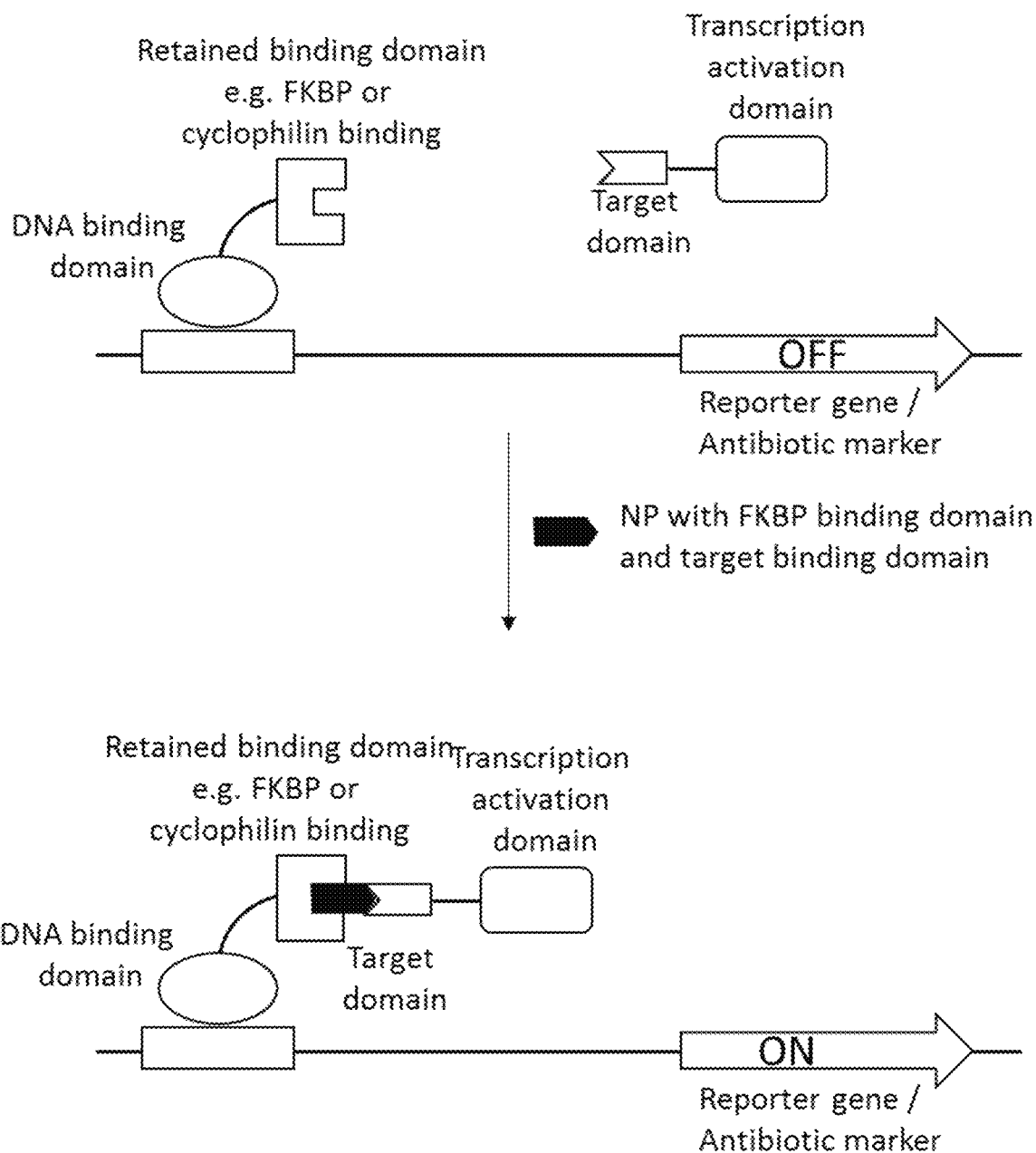
FIG. 10: Overview of one example version of the three-hybrid selection system.
Figure 11C:
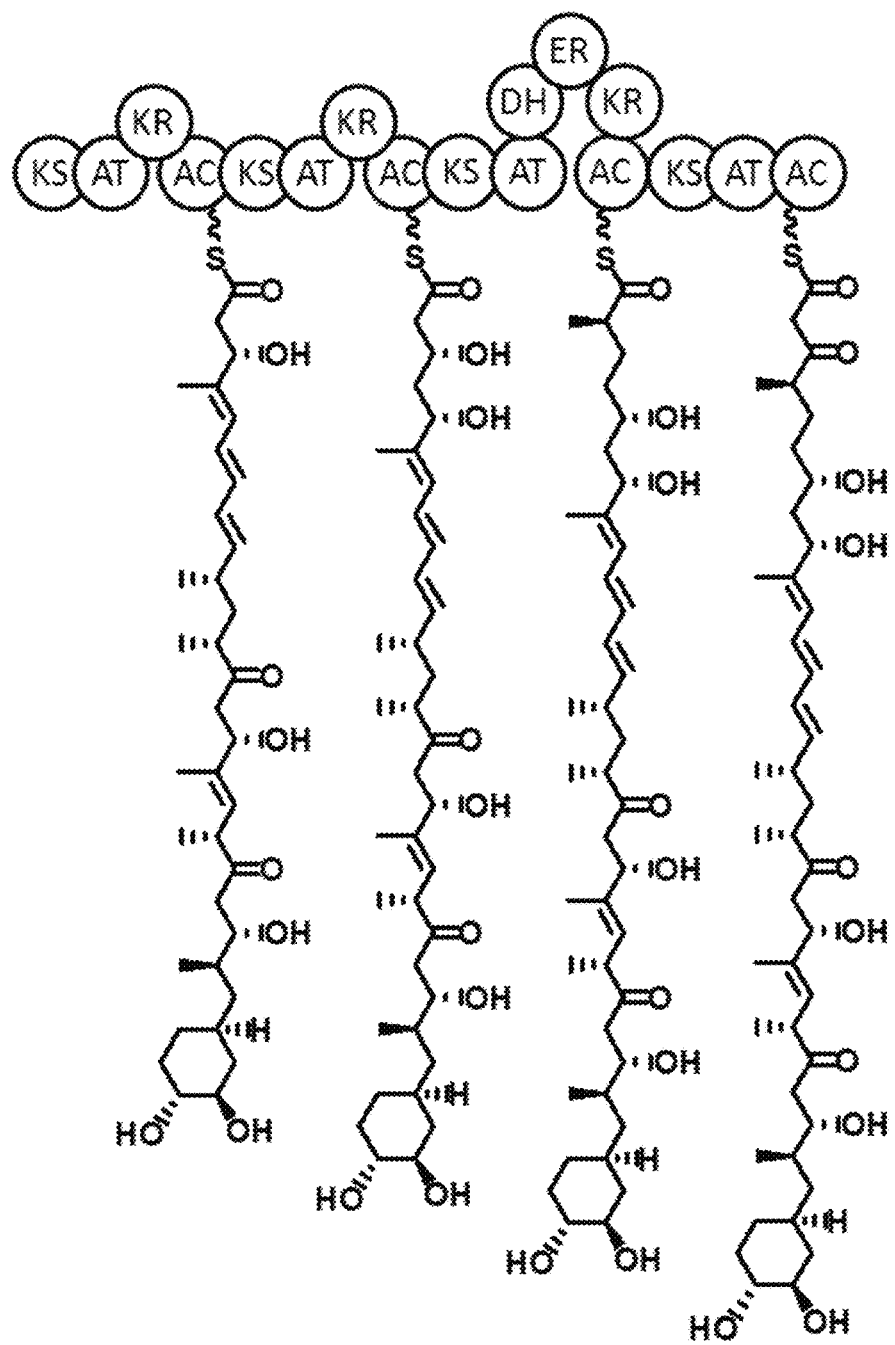
Figure 11D:
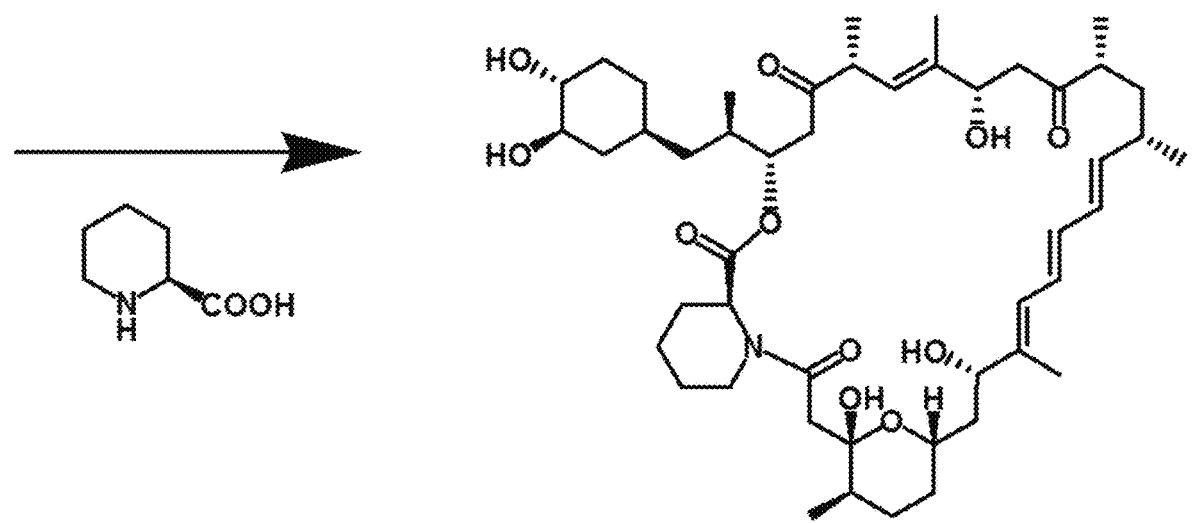
Figure 11E:
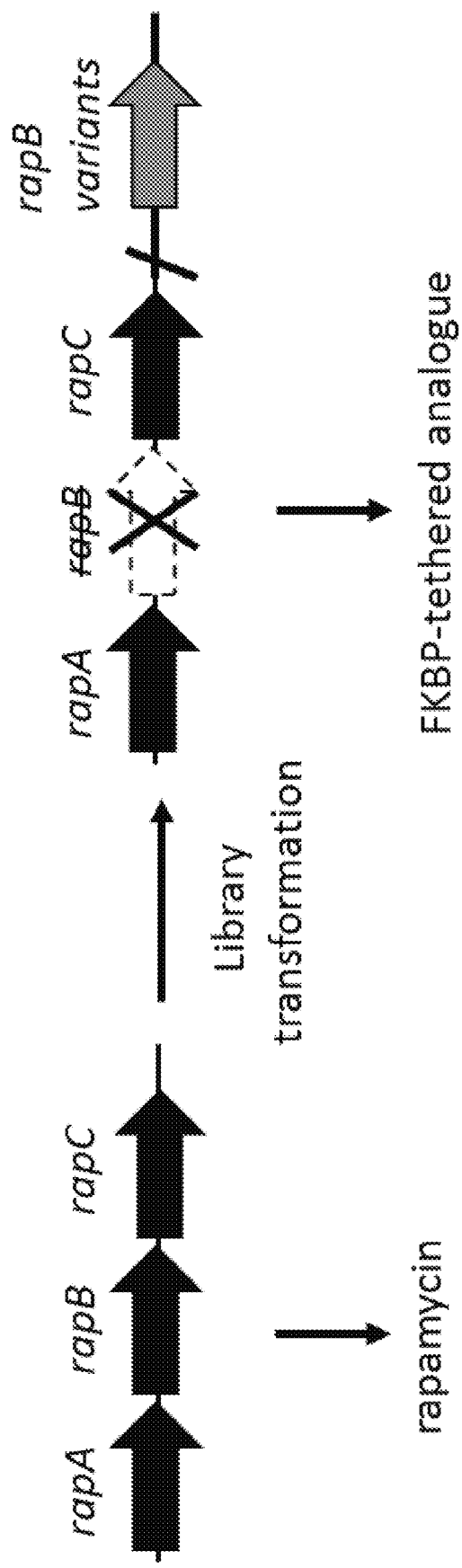
Figure 11F:
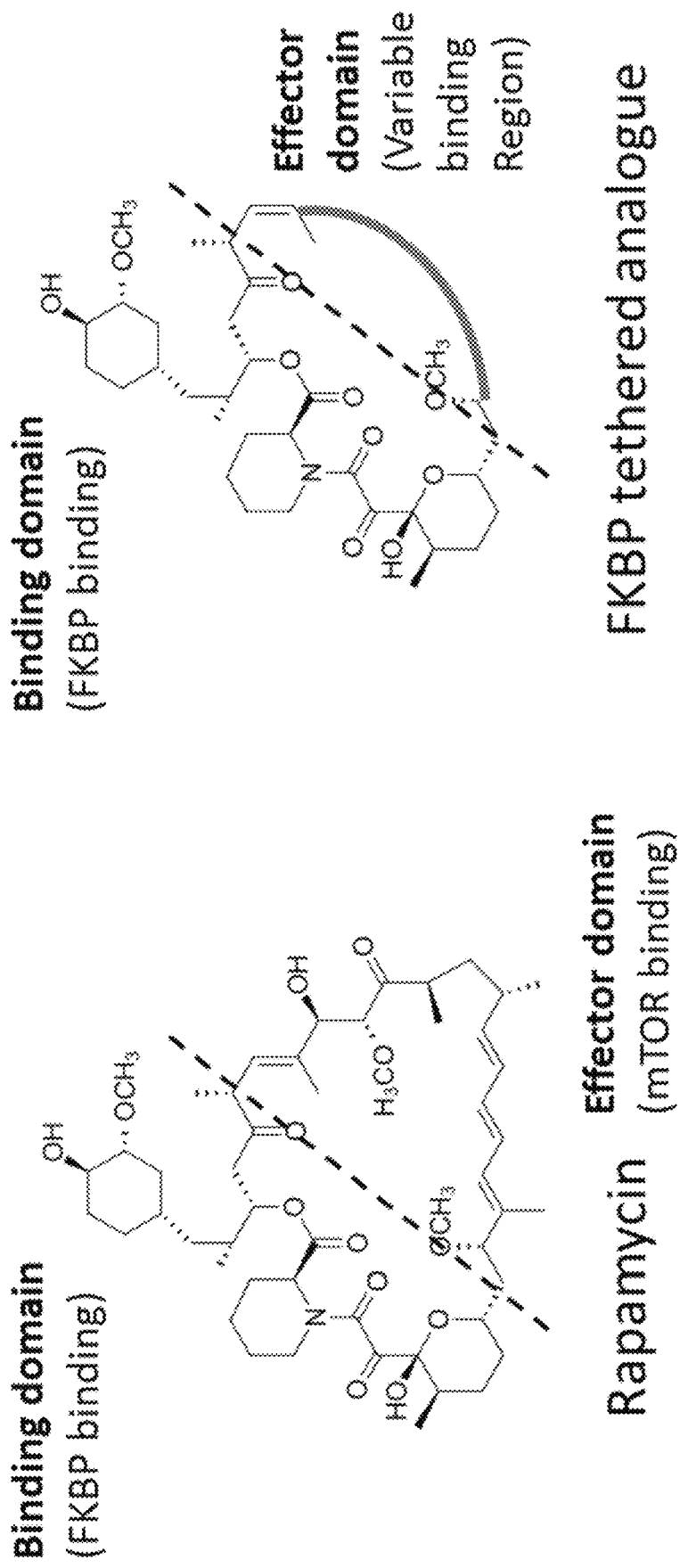
Figure 12A:
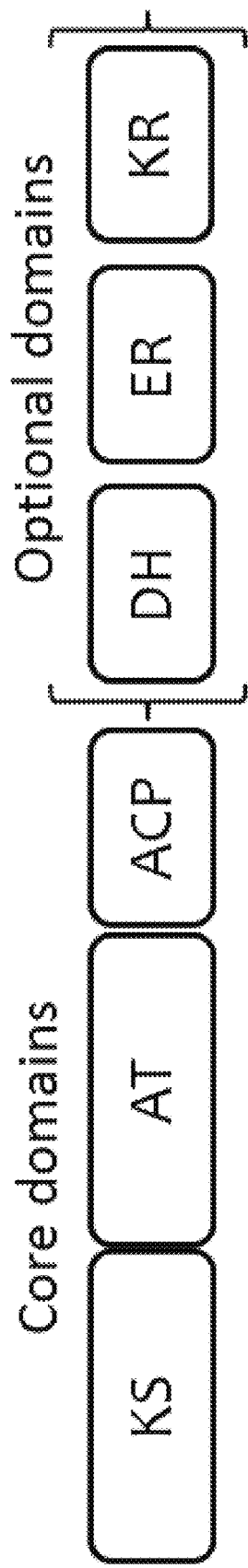
FIGS. 12A-12B.
Figure 12B:
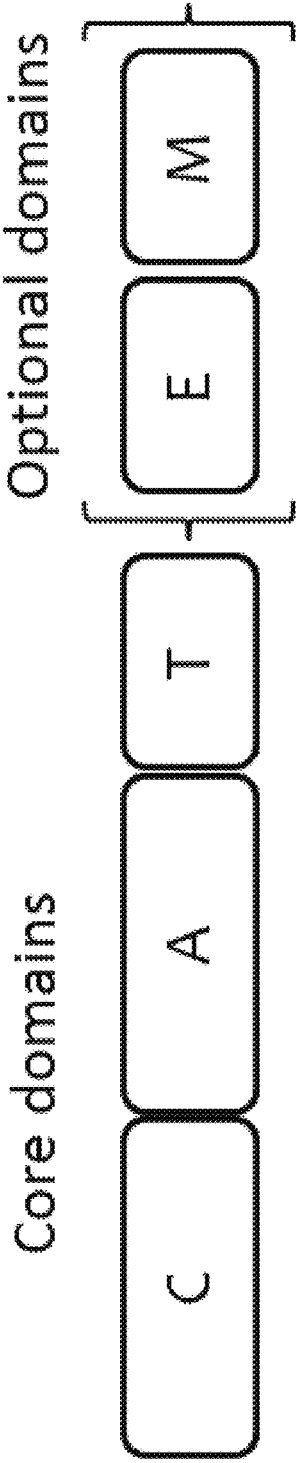

FIG. 10 illustrates an example of this aspect of the invention in which the first element comprises a first domain which is a DNA binding domain and a second domain which is a Retained binding domain (e.g. FKPB or cyclophilin) and the second element comprises a first domain which is a transcriptional activation domain and a second domain which is a Target domain. Binding of a natural product capable of binding to the Retained binding domain and the Target domain leads to activation of transcription of the reporter gene (e.g. an antibiotic resistance gene).

Figure 17:
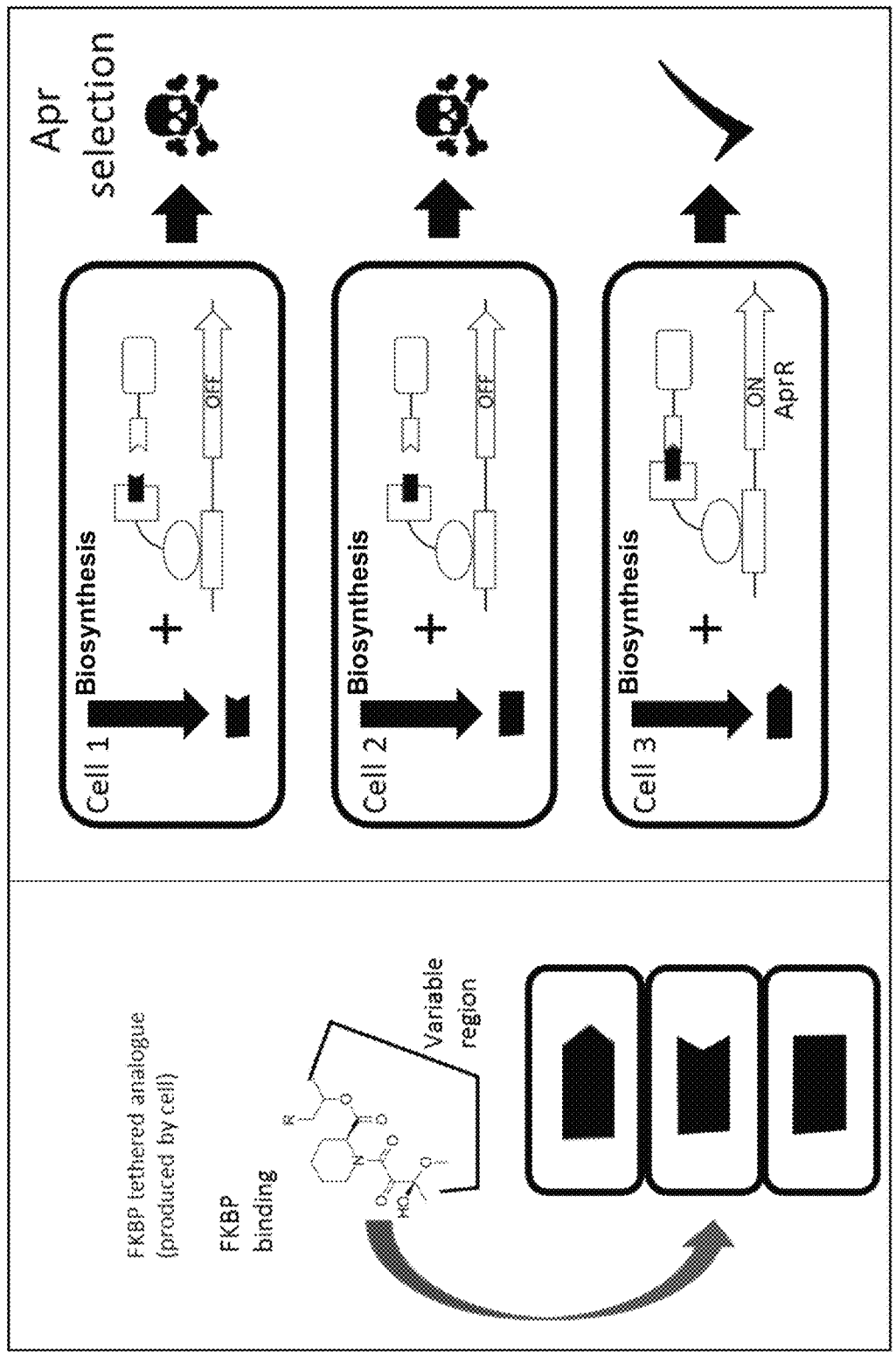
FIG. 17: A pictorical representation of the combination of PK/NRP diversity generation and a three-hybrid selection system to select for cells producing products that bind to a Target domain.
Figure 18A:
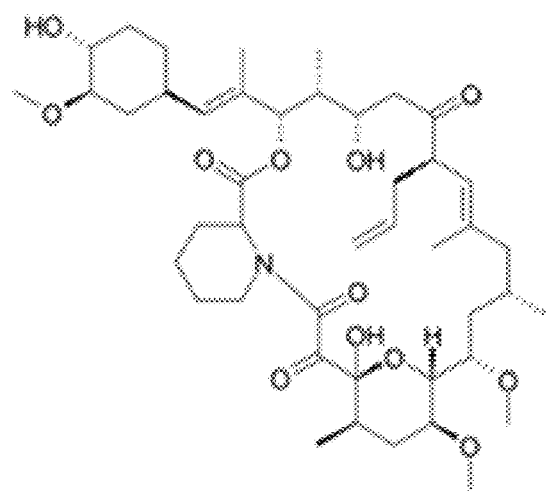
FIGS. 18A-18D: Images of agar plates containing apramycin and two strains containing three-hybrid selection systems expressed in a PKS expressing streptomycete (see Example 23).
Figure 18B:
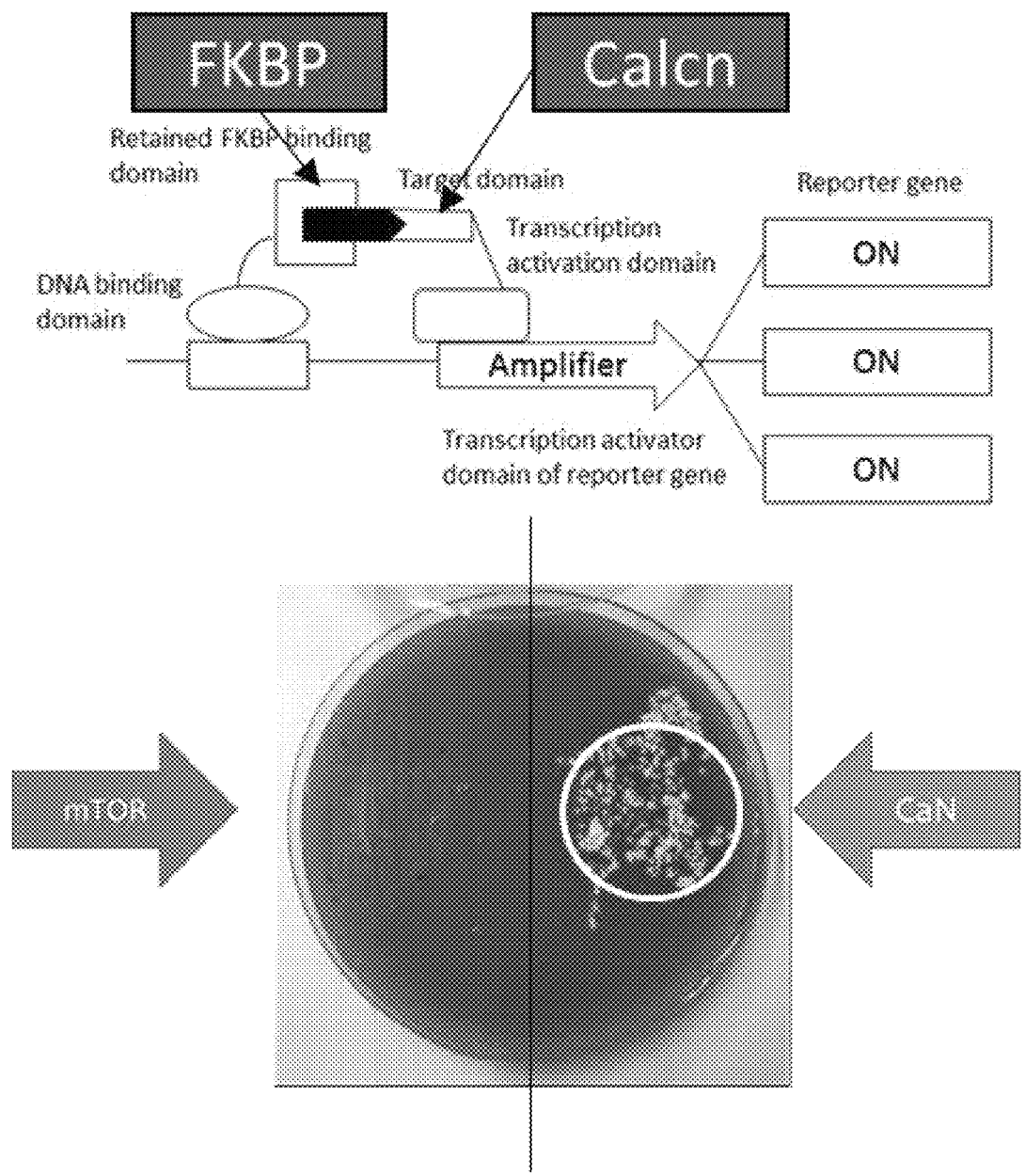
Figure 18C:
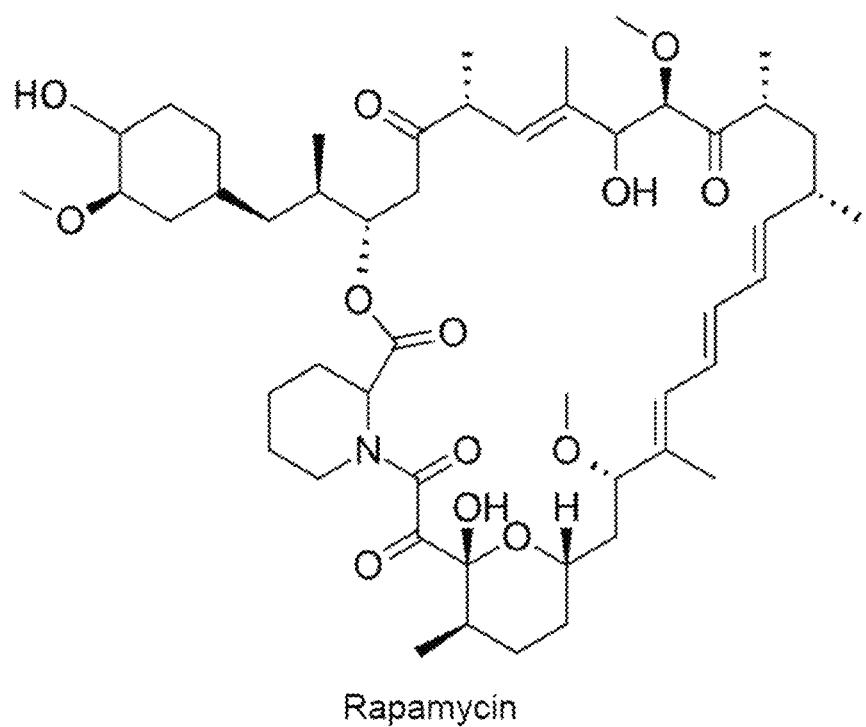
Figure 18D:
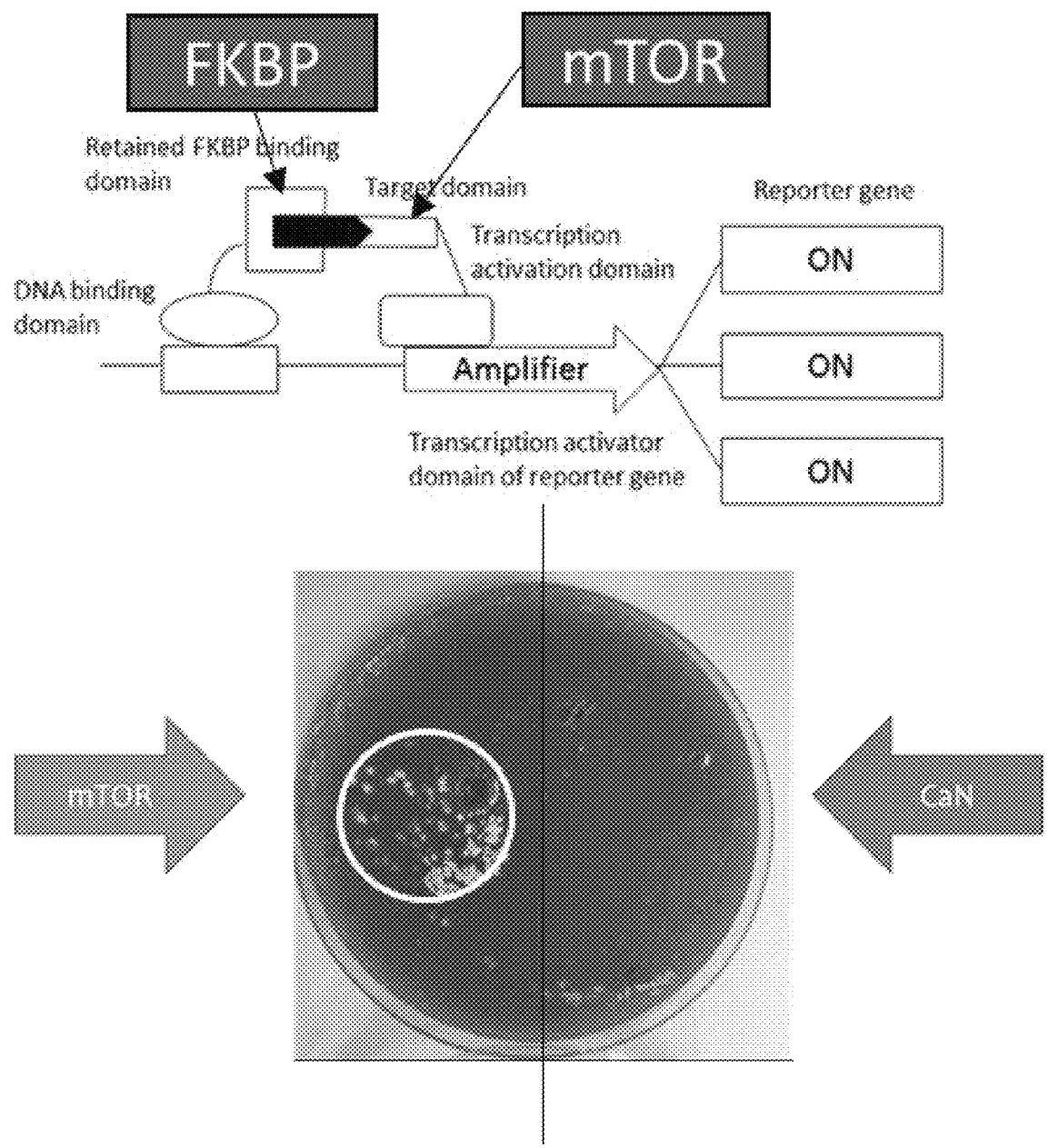

FIG. 17 is a schematic that illustrates how three different cells produce molecules having a common FKBP binding region (the first element) and different second binding regions.

In the schematic, only the molecule produced by Cell 3 binds the second element and causes expression of the reporter gene. In this instance the reporter gene is an apramycin resistance gene and thus when grown on apramycin the cells of Cell 3 survive whereas those of Cell 1 and Cell 2 do not.

As explained further in Example 23, FIG. 18 shows images of agar plates containing apramycin and two strains containing three-hybrid selection systems expressed in a PKS expressing streptomycete. The left side of the plates contains a strain expressing a three-hybrid selection system where the retained domain is FKBP and the Target domain is calcineurin. The right side of the plates contains a strain expressing a three-hybrid selection system where the retained domain is FKBP and the Target domain is mTOR. In both cases one of the reporter genes is an apramycin resistance gene. When rapamycin is present, only the mTOR domain strains survive when grown on apramycin. When FK508 is present, only the calcineurin domain strains survive when grown on apramycin. FIG. 18 also illustrates an embodiment where the binding of the three elements of the three-hybrid selection system leads to transcriptional activation of an amplifier which activates three reporter genes one of which is an apramycin resistance gene. The other reporter genes could be, for example, visible marker genes (including fluorescent marker genes).

Figure 19:
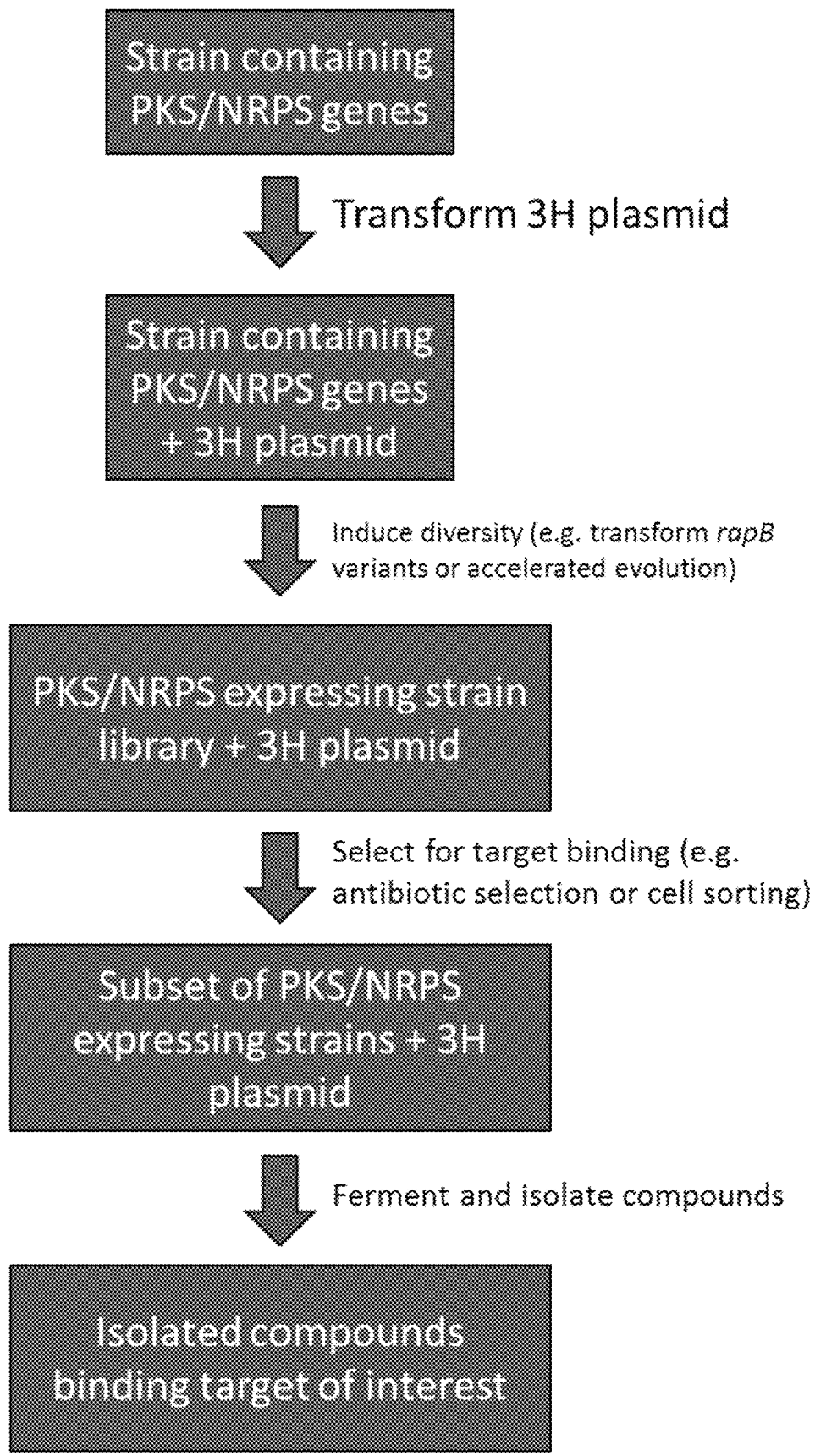
FIG. 19: A flow chart representation of an example process to generate a library, select for strains expressing PKs or NRPs binding to the target and isolating these compounds.

FIG. 19 shows a method for identifying compounds of interest in a strain containing PKS/NRPS genes (or a partial set of genes which may include inactive genes) which is transformed with the necessary elements of a three-hybrid selection system. Diversity of compound production may be induced as described elsewhere herein e.g. by means of accelerated evolution or by transforming with complementing genes or variant genes or portions of genes (e.g portions encoding one or more domains or modules of a PKS or NRP).

Figure 20:
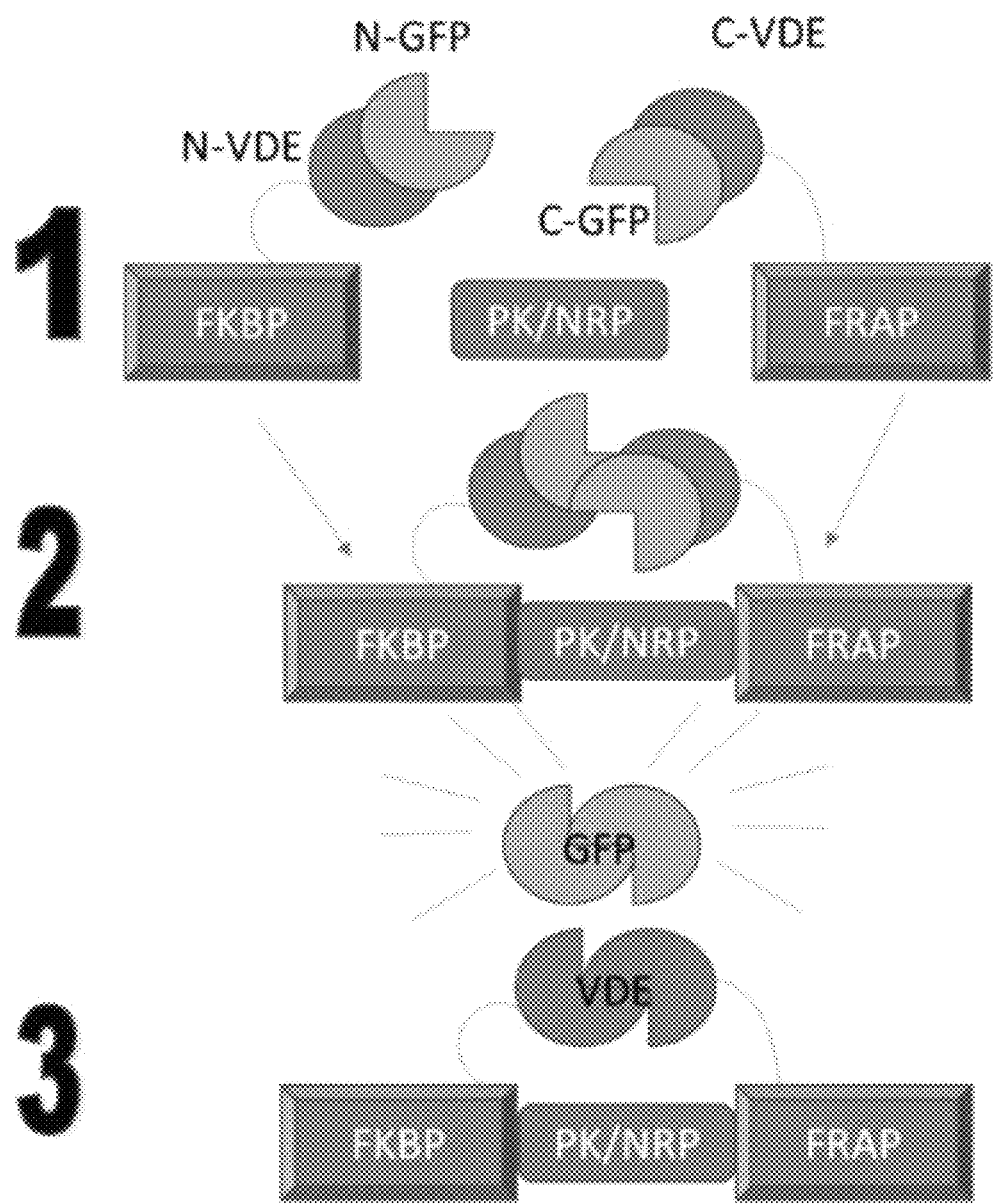
FIG. 20: An intein-based three hybrid system as described in Example 26.

FIG. 20 illustrates the intein splicing embodiment in three stages. Stage 1: All elements of the system are genetically encoded: the first element is a protein comprising a N-terminal half of the reporter protein (GFP), N-terminal VDE sequence and FKBP capable of recognising the ligand (PK or NRP). The second element consists of a C-terminal half for the reporter protein (GFP), C-terminal VDE sequence and FRAP capable of binding to FKBP upon ligand binding. Stage 2: Genetically-encoded machinery for production of PK/NRP provides the ligand for the selection machinery, and the ligand bridges FKBP and FRAP bringing the selection elements together. Stage 3: Ugand binding triggers splicing of the elements, and the functional, fluorescent GFP is produced and acts as a reporter that can be detected.

Thus the invention provides a process for selecting or identifying a cell which produces a desired natural product selected from polyketides and non-ribosomal proteins which comprises (I) expressing or producing in the cel a three-hybrid selection system comprising first and second elements which are proteins and a third element which is a natural product selected from polyketides and non-ribosomal proteins; wherein when the third element is a desired natural product the first and second elements can bind the said third element and wherein simultaneous binding of the first and second elements to the said third element leads to a detectable change in the cell; and (11) selecting or identifying the cell in which the detectable change occurs. The invention further provides such a process for selecting or identifying a cell which produces a desired natural product selected from polyketides and non-ribosomal proteins which further comprises the step of isolating the selected or identified cell.

In a specific aspect, the invention provides a small molecule three-hybrid selection system which includes a library of cells producing different NPs (i.e. PKs or NRPs), each containing the same protein components of the three-hybrid selection system (e.g., a DNA binding protein, a transcription activation protein and a reporter gene product), with a variable PKS gene. This method can be used to select for cells producing NPs (i.e. PKs or NRPs) which bind both a first protein (such as FKBP or cyclophilin) and a second protein (such as mTOR-FRAP or calcineurin). The protein which can bind an NP (i.e. a PK or NRP)is fused to a DNA-binding domain. The second protein which can bind an NP (i.e. a PK or NRP is fused to a transcription activation domain, such that when a cell produces an NP (I.e. a PK or NRP which binds to both the first protein domain and the second protein domain, the complex drives transcription from a promoter sequence upstream of a reporter gene (see FIG. 10). The complex may initiate transcription from a promoter sequence upstream of a signal amplifier which leads to expression of a reporter gene or genes. Cells are selected on the basis of production of the reporter gene product. For example the reporter gene is an antibiotic resistance gene and cells are grown in the presence of the antibiotic such that cell growth is only allowed when the cell produces a small molecule NP (i.e. a PK or NRP) which binds to both and lead to expression of an antibiotic resistance gene. Alternatively the product of the reporter gene provides the basis for cell sorting e.g. by FACS.

The method is adapted for selecting or identifying NPs (I.e. PKs or NRPs) which bind to both the first and second protein domains. For example, the method can select NPs (i.e. PKs or NRPs) which have a common structure which binds to the first protein domain and are variable in the respect in which they bind to the second protein domain. Alternatively the method can select NPs (i.e. PKs or NRPs) which have a common structure which binds to the second protein domain and are variable in the respect in which they bind to the first protein domain. The variation in structures of the produced NPs (i.e. PKs or NRPs) is generated by variation in genes coding for PKS which generate the corresponding part of the NP (i.e. a PK or NRP) molecule (for example rapB in rapamycin). FIG. 11 is an illustration whereby analogues of rapamycin are generated which have a common region capable of binding FKBP and a variable region which may (or may not) bind to mTOR-FRAP. The variation may be achieved by mutation of the rapB gene (or deletion of the rapB gene and replacement of a variant). Of course the same principle applies to any other type 1 modular PKS or modular NRPS.

The invention also provides a system for selecting or identifying a cell which produces a desired natural product selected from polyketides and non-ribosomal peptides from a library of cells producing natural products selected from polyketides and non-ribosomal peptides wherein the cells express or produce (i) as a first element a protein comprising a DNA binding domain which can recognise a DNA sequence upstream of a reporter gene and a domain which can bind part of said desired natural product; (ii) as a second element a protein comprising a transcription activation domain which is capable of activating transcription of a reporter gene and a domain which can bind part of said desired natural product at a different location to the first element; and (ill) one or more natural products selected from polyketides and non-ribosomal peptides; wherein the cells are capable of expressing or producing a reporter gene product; whereby if a cell in the library produces the desired natural product which binds to the first and second elements, then transcription of the reporter gene occurs and the cell may be selected or identified on the basis of its production of the reporter gene product.

The Invention also provides a method for selecting or identifying a cell which produces a desired natural product selected from polyketides and non-ribosomal peptides from a library of cells producing natural products selected from polyketides and non-ribosomal peptides which comprises (a) expressing or producing in the library of cells (I) as a first element a protein comprising a DNA binding domain which can recognise a DNA sequence upstream of a reporter gene and a domain which can bind part of said desired natural product; (ii) as a second element a protein comprising a transcription activation domain which is capable of activating transcription of a reporter gene and a domain which can bind part of said desired natural product at a different location to the first element; and (iii) one or more natural products selected from polyketides and non-ribosomal peptides; which cells are capable of expressing or producing a reporter gene product; and (b) selecting or identifying a cell from the library in which transcription of the reporter gene occurs and the reporter gene product is produced.

The invention also provides a system for selecting or identifying a cell which produces a desired natural product selected from polyketides and non-ribosomal peptides from a library of cells producing natural products selected from polyketides and non-ribosomal peptides wherein cells transformed with one or more nucleic acid vector constructs together encoding (i) as a first element a protein comprising a DNA binding domain which can recognise a DNA sequence upstream of a reporter gene and a domain which can bind part of said desired natural product; (i) as a second element a protein comprising a transcription activation domain which is capable of activating transcription of a reporter gene and a domain which can bind part of said desired natural product at a different location to the first element; (iii) a reporter gene and (iv) one or more polyketide synthases or non-ribosomal peptide synthetases or one or more genes thereof are cultured and if a cell in the library produces the desired natural product which binds to the first and second elements, then transcription of the reporter gene occurs and the cell may be selected or identified on the basis of its production of the reporter gene product.

The invention also provides a method for selecting or identifying a cell which produces a desired natural product selected from polyketides and non-ribosomal peptides from a library of cells producing natural products selected from polyketides and non-ribosomal peptides which comprises (a) culturing a library of cells transformed with one or more nucleic acid vector constructs together encoding (1) as a first element a protein comprising a DNA binding domain which can recognise a DNA sequence upstream of a reporter gene and a domain which can bind part of said desired natural product; (ii) as a second element a protein comprising a transcription activation domain which is capable of activating transcription of a reporter gene and a domain which can bind part of said desired natural product at a different location to the first element; (iii) a reporter gene and (iv) one or more polyketide synthases or non-ribosomal peptide synthetases or one or more genes thereof; and (b) selecting or identifying a cell from the library in which transcription of the reporter gene occurs and the reporter gene product is produced.

A feature of the methods of the invention is that the library of cells from which the desired cell is selected can potentially be quite substantial in size. Thus the libraries may contain 2 or more different cells, or example 10 or more different cells, for example 100 or more different cells, for example 1000 or more different cells. By "different cells" is meant cells which produce different natural products selected from polyketides and non-ribosomal peptides.

The invention also provides a nucleic acid vector construct or set of nucleic acid constructs together encoding elements of a three-hybrid selection system comprising ( ) first and second elements which are proteins which can bind part of a natural product selected from polyketides and non-ribosomal peptides; and (ii) a reporter gene. Such a nucleic acid vector construct or set of nucleic acid constructs may further encode (iii) one or more polyketide synthases or non-ribosomal peptide synthetases which produce said natural products or parts thereof.

Specifically, the invention also provides a nucleic acid vector construct or a set of nucleic acid vector constructs together encoding (i) as a first element a protein comprising a DNA binding domain which can recognise a DNA sequence upstream of a reporter gene and a domain which can bind part of said desired natural product; (ii) as a second element a protein comprising a transcription activation domain which is capable of activating transcription of a reporter gene and a domain which can bind part of said desired natural product at a different location to the first element; (iii) a reporter gene and (iv) one or more polyketide synthases or non-ribosomal peptide synthetases which produce natural products selected from polyketides and non-ribosomal peptides. The nucleic acid vector construct or set of nucleic acid vector constructs together may alternatively (in place of part (v)) encode a part of one or more polyketide synthases or non-ribosomal peptide synthetases which produce natural products selected from polyketides and non-ribosomal peptides e.g. In circumstances where the cells to be transformed already contain PKS or NRPS genes (or parts thereof).

For example, one or more nucleic acid vector constructs (or a first set of nucleic acid vector constructs) encodes (i) as a first element a protein comprising a DNA binding domain which can recognise a DNA sequence upstream of a reporter gene and a domain which can bind part of said desired natural product; (ii) as a second element a protein comprising a transcription activation domain which is capable of activating transcription of a reporter gene and a domain which can bind part of said desired natural product at a different location to the first element; and (lii) a reporter gene and a second nucleic acid vector construct (or a second set of nucleic acid vector constructs) encodes one or more polyketide synthases or non-ribosomal peptide synthetases or one or more genes thereof.

The Invention also provides a nucleic acid vector construct or set of nucleic acid constructs together encoding elements of a three-hybrid selection system comprising (i) first and second elements which are proteins which can bind part of a natural product selected from polyketides and non-ribosomal peptides; (i) a first fragment of a splicing enzyme fused to a first fragment of a reporter gene; and (iii) a second fragment of a splicing enzyme fused to a second fragment of a reporter gene. Such a nucleic acid vector construct or set of nucleic acid constructs may be used to prepare cells according to the splicing embodiment. For example constructs together or separately in a set comprise a first fragment of a splicing enzyme fused to a first fragment of a reporter gene and a second fragment of a splicing enzyme fused to a second fragment of a reporter gene see (Mootz et al, 2002). For example the first fragment of a splicing enzyme may be an N-terminal fragment of a splicing enzyme and the first fragment of a reporter gene may be an N-terminal fragment of a repoirter gene and the second fragment of a splicing enzyme may be a C-terminal fragment of a splicing enzyme and the second fragment of a reporter gene may be a C-terminal fragment of a reporter gene Thus, the invention also provides a process for preparing a cell or library of cells which comprises transforming a cell or strain of cells with such a nucleic acid vector construct or set of nucleic acid constructs (such as plasmids) such that a natural product is produced. Such cells or strain of cells may also be transformed with one or more nucleic acid vector constructs which encode PKS or NRPS genes or parts of them (e.g. parts that encode one or more domains or modules). In an embodiment, the cells or strain of cells contain PKS or NRPS genes prior to transformation. In an embodiment, the cells or strain of cells do not contain PKS or NRPS genes prior to transformation.

The DNA binding domain of the first element will typically be a domain which has been described for this purpose in a two hybrid or three-hybrid selection system, and may be an artificial or natural sequence. An example is a lambda cl binding domain. Other examples include, but are not limited to a TAL effector DNA-binding domain, a B3 domain, a designer zinc-finger protein, a Lambda Cro repressor, a bacteriophage 434 C1 and Cro repressor, a P22 C2 repressor, a bacteriophage Mu Ner protein, a purine repressor (PurR) DNA-binding domain, a lactose repressor (Lacr) DNA-binding domain a fructose repressor (FruR) DNA-binding domain, a Oct-1 DNA-binding domain, a Pit-1 DNA-binding domain and a Hepatocyte nuclear factor 1a (LFB1/HNF1) DNA-binding domain.

The reporter gene can be any gene whose expression can conveniently be detected and whose transcription is regulated (e.g. activated by the transcription activation domain). Reporter genes include selectable markers and visible markers (including fluorescent markers). The reporter gene could be an antibiotic resistance gene, such as aac(3)IV, allowing for selection of the cell using an antibiotic, such as apramycin. Thus the cells are selected in the presence of the antibiotic such that only the cells that produce the appropriate NP (i.e. PK or NRP) can survive. The reporter gene could be another marker, such as a visible (e.g. fluorescent) marker, such as a chromoprotein, such as eGFP, or mCherry, which would allow selection of cells using a cell sorter such as FACS. Microfluidics based methods may also be used for selection (Fu et al., 1999). The reporter gene may also encode a product which complements an auxotrophic pathway, thereby allowing the organism to synthesize a substance which it otherwise is unable to. Cells which are complemented in this way can be detected e.g. because they increase in number disproportionately or because they survive when others not so complemented do not Generally, the reporter may encode products whose presence (or reduced presence or absence as a result of down regulation) which can be detected by various means, including but not limited to spectroscopy, Fluorescence activated cell sorting (FACS) or growth of a cell on a selective medium.

It will be understood that references to a reporter gene include the encoded gene product and regulatory elements therefor (including elements to allow for transcriptional regulation).

Products of reporter genes referred to above may be employed as reporters according to the splicing embodiment Preferably there is more than one reporter gene, allowing for reduction of false positives due to mutation of the reporter gene promoter or else providing choice as regards the method of detection. For example one reporter gene is an antibiotic resistance gene and one reporter gene is a visible marker gene e.g. a fluorescent marker gene.

The transcription activation domain of the second element activates transcription of the reporter gene. Preferably this is a domain which binds to RNA polymerase. Most preferably this is a domain which has been used for this purpose in a two hybrid or three-hybrid selection system, such as a subunit N-terminal domain (α-NTD) of RNA polymerase. Other examples include, but are not limited to w-subunit of RNA polymerase.

The DNA sequence upstream of the reporter gene is located upstream, within the 5' untranslated region of the reporter gene and contains a recognition sequence for the DNA-binding domain contained in the three-hybrid selection system. Examples of DNA binding domains and recognition sequences that can be used include fixed, canonical sequences recognised by specific established DNA binding domains, including Helix-turn-helix domain (for example from codon optimised cl lambda-usually 20 amino-acids long), Leucine zipper domain (for example from codon-optimised AP-1), Winged helix domain (for example from codon-optimised Storkhead-box protein), Winged helix-turn-helix (for example from codon-optimised LexA repressor), HMG-box domain (for example from a codon-optimised SOX transcription factor), Wor3 domain (for example from the codon-optimised White-Opaque Regulator 3), or 'designer' de novo sequences designed rationally to bind with an engineered DNA binding domain of a protein, such as a TAL effector domain (usually a region of tandem 33-35 residue repeats, and each repeat region encodes one DNA base in the TAL-effector's binding site) or Zinc finger domain (usually a sequence of 23 to 28 amino acids stabilized by coordinating zinc ions with regularly spaced zinc-coordinating residues (either histidines or cysteines)). These sequences are designed in silico according to design rules, and then an online algorithm is applied to design a DNA-binding domain. In the three-hybrid selection system, the DNA-binding domain is fused to the receptor for a small molecule (the Retained binding domain), such as FKBP or cyclophilin. The binding of the DNA binding domain in the presence of the small molecule target recruits the RNA polymerase and initiates transcription (and expression) of the reporter gene.

The domain of the first and second elements which binds part of said desired natural product can be selected from known PK or NRP binding domains including FKBP, cyclophilin, mTOR FRAP binding domains and calcineurin. For example the domain of the first and second elements which binds part of said desired natural product can respectively be FKBP and mTOR-FRAP, FKBP and calcineurin or cyclophilin and calcineurin. Alternatively the domain of the second and first elements which binds part of said desired natural product can respectively be FKBP and mTOR-FRAP, FKBP and calcineurin or cyclophilin and calcineurin.

Further Target domains (i.e. domains of the second element to bind to the natural product) may be selected from viral, eukaryotic and prokaryotic proteins including domains involved in protein-protein interactions, domains involved in DNA binding, domains involved in intracellular signalling, domains involved in small molecule binding.

Other examples of Target domains include domains of the following: mitochondrial or subcellular targets such as lysosomal enzymes, heat shock proteins, mitochondrial carriers, apoptotic factors, transporters and intracellular receptors, or intracellular pathogen protein targets such as fusion promoters, proteins involved in host-cell signalling pathways, pathogen and parasite maintenance and survival factors, nuclear targets such as intracellular or nuclear membrane GPCRs, modulators of gene expression (such as transcription factors), factors involved in cell cycling, chromatin proteins, DNA and DNA-binding proteins, RNA and RNA-binding proteins, inhibitors or activators of RNA or DNA processing, or cytoplasmic targets such as kinases or enzymatic targets.

More generally, the Target domain can be a domain of a protein target where binding by a natural product is feasible. This list is long, and includes, but is not limited to, all proteins against which mAbs have been successfully generated and where in vitro binding has been achieved.

An FKBP may be selected from FKBP12, FKBP51, FKBP52, FKB5, FKBP2, FKBP13, FKBP38, FKBP42, FKBP42b, FKBP62, FKBP65, FKBP72, FKBP75, FKBP15-1, FKBP15-2, FKBP153, FKBP20-1, FKBP20-1b, FKBP53, FKBP43, FKBP43b, FKBP16-1, FKBP16-2, FKBP18-3, FKB16-4, FKBP17-1, FKBP17-2, FKBP17-3, FKBP18, FKBP19, FKBP20-2 andFKBP25.

A cyclophilin may be selected from Cyclophilin A, Cyclophilin B, Cyclophilin C, Cyclophilin D and Cyclophilin S.

Further, the domain of the first and second elements which binds part of said desired natural product can be selected from Trigger factor, Parvulin, Parl0, PPiC, PrtM, NifM, SurA, PrsA, PpiD, PmpA, Ess1, Ptfl and PIN1.

Cells transformed with nucleic acid vector constructs encoding (I) as a first element a protein comprising a DNA binding domain which can recognise a DNA sequence upstream of a reporter gene and a domain which can bind part of said desired natural product; (ii) as a second element a protein comprising a transcription activation domain which is capable of activating transcription of a reporter gene and a domain which can bind part of said desired natural product at a different location to the first element; and (ili) one or more polyketide synthases or non-ribosomal peptide synthetases which produce natural products selected from polyketides and non-ribosomal peptides may have been transformed with one or more nucleic acid vector constructs (i.e. the various elements do not need to be contained on the same nucleic acid vector construct). For example they may be contained on one or more plasmids.

Nucleic acid vector constructs encoding one or more polyketide synthases or non-ribosomal peptide synthetases which produce natural products selected from polyketides and non-ribosomal peptides will encode the appropriate number of genes for the polyketide synthases or non-ribosomal peptide synthetases in question to produce polyketides or non-ribosomal peptides. The library of cells may be diverse in containing mutations or variations in one or more genes of the polyketide synthase or non-ribosomai peptide synthetase. As used herein, the binding domain of the first or second element which binds to a part of a polyketide or non-ribosomal peptides which part is not diverse as between cells in the library may be called a "Retained binding domain". A binding domain of the first or second element which binds to a part of a polyketide or non-ribosomal peptides which part is diverse as between cells in the library may be called a "Target domain".

Cells transformed with nucleic acid vector constructs are preferably transformed with a nucleic acid vector constructs which is DNA especially double stranded DNA. Nucleic acid vector constructs are most suitably plasmids. The plasmids are suitably double stranded DNA plasmids.

Suitably the cell is the cell of a bacterium especially an actinomycete such as an actinomycete selected from *Streptomyces rapamycinicus, Streptomyces* lasallensis, Actinosynnema pretiosum, *Streptomyces* biMniensis, *Streptomyces graminofaciens, Streptomyces* sp., *Streptomyces* vlrginlae, Sorangium cellulosum, Mcromonospora megalomicea, *Streptomyces* halstedi, *Streptomyces* spiroverticullatus, *Streptomyces* avenmrilis, *Streptomyces aureofaciens, Streptomyces hygroscopicus, Streptomyces* geldanamycininus, *Streptomyces* sahachiroi, *Xanthomonas* albilineans, Amycolatopsis balhimycina, *Streptomyces* ver,tcillus, *Acinetobacter* baumanrwi, *Bacillus* amyldiquefaciens, Badllus lcheniformls, *Streptomyces* lohii, Steptomyces nanchangensis, *Streptomyces* caelesds, *Streptomyces violaceusniger, Streptomyces noursel, Streptomyces* sp. HK603, *Streptomyces* piomogenus, *Streptomyces* venezuelae, Saccharopo/yspor elythraea, *Streptomyces natalensis, Streptomyces platensis, Pseudomonas fluorescens, Streptomyces* sp. SN-593, Amycolatopsis medterranei, *Streptomyces achromogenes, Streptomyces albus, Streptomyces* sp. CK4412, *Streptomyces* spirovercllatus, Steptomyces sp. NRRL 11266, *Streptomyces* gnseus, *Streptomyces* ambofacians, Saccharopolyspora *spinosa*, Streptoryces *flaveolus*, Nocardiopsis sp. FU40, *Streptomyces violaceoruber, Streptomyces* sp. ATCC 39366, *Streptomyces bottropensis, Streptomyces* sp. CS40, *Streptomyces* lavendiae, *Streptomyces* triostnicus, *Bacillus* amyloUuefadens, Actinomadura kijariata, *Streptomyces rochei, Bacillus amytoliquefadens, Pseudomonas* fluomescens, Micromanospora griseorubida, *Streptomyces* cyaneogriseus, Steptomyces andbioticus, Streptomryces *platensis, Stigmatella* aurandaca, *Streptomyces* lasaliensis, *Streptomyces* sp. MK498-98 F14, *Streptomyces* fungickicus, *Streptomyces* pnstinaespiralis, Streptomryces *lividans, Streptomyces coellcolor, Streptomyces roseosporus, Streptomyces* actuosus, Streptoverdcillium sp. ATCC33160, *Streptomyces fradiae, Streptomyces mycarofacens, Streptomyces longisporoflavus, Streptomyces parvulus, Streptomyces anfbiotcus, Streptomyces incamates, Streptomyces tsukubaensis, Streptomyces nrmosus, Streptomyces cinnamonensis, Streptomyces parvdus, Micromonospora megalomicea, Streptomyces diastatochromogenes, Streptomfyces nodosus, Streptomyces varsovlensis, Streptomyces* setse and their derivaves. Alternatively, the cell is the cell of another heterologous host, such as *Escherichia coli*.

The cell may also be a non-bacterial host cell, such as a fungal cell particularly a yeast cell especially wherein the yeast is Saccharomyc.s *cerevisiae*. More generally, yeast species of interest include those of the genera Saccharonyces, *Hansenula, Kluyveromyces* and Piccha.

In an embodiment, the cell is a PK or NRP producing host (such as an actinomycete) in which one or more PKS or NRPS genes has been deleted or inactivated. The corresponding deleted/inactivated gene can be replaced in mutated form with a gene conveyed on a nucleic acid vector construct (e.g. a plasmid) with which the cell is transformed. Thus, in effect, a gene in the transforming DNA complements a missing or defective gene in the host cell. For example the host cell expresses a rapamycin PKS with a missing or inactive rapB gene (I.e. a rapamycin PKS with a missing or inactive rapB gene is contained in the host cell genome). A replacement (mutant) rpB gene may be provided on the nucleic acid vector construct (e.g. plasmid) with which the host cell is transformed. Alternatively the cell is not PK or NRP producing (e.g. *E. Coli*) and all the PK and NRPS genes are provided e.g. on one or more plasmids. Alternatively the cell is PK or NRP producing (e.g. an actinomycete) however all the PKS or NRPS genes are deleted or inactivated and are replaced (e.g. carried on a nucleic acid vector construct such as a plasmid) by the genes of a heterologous PKS or NRPS.

Desired NPs Include PKs e.g. selected from rapamycin, sanglifehrins such as sanglifehrin A, FK506, FK520, meridamycin, antascomycin, nocardiopsins such as nocardiopsin A and catramycin.

Thus for example the natural product or desired natural product is an analogue of rapamycin. Cells may express a rapamycin PKS with a missing or inactive rapB gene and the cells are transformed with nucleic acid comprising a mutant rapB gene.

Desired NPs include NRPs e.g. selected from cyclosporines such as cyclosporine A.

A favoured NP is rapamycin or an analogue thereof.

Another favoured NP is tylosin or an analogue thereof.

Suitable PKSs include PKSs capable of producing any of the aforementioned PKs, such as rapamycin PKS-. Another favoured PKS is tylosin PKS.

Suitable NRPSs include NRPSs capable of producing any of the aforementioned NRPs.

As noted above, mutations or variations in any gene encoding a part of a polyketide synthase or a non-ribosomal peptide synthetase may be introduced into cells of a library. For example, in the case of the rapamycin PKS, different mutations in rapB gene may be introduced.

Polyketide and non-ribosomal peptide molecules may be produced by culturing cells which are selected for according to methods described herein. Polyketide and non-ribosomal peptide molecules can be isolated from the cel cultures. Such polyketide and non-ribosomal peptide molecules may have therapeutic activity and may be formulated in pharmaceutical compositions and used as pharmaceuticals. Polyketide and non-ribosomal peptide molecules have been found to be useful in a number of therapeutic areas, such as oncology and infectious diseases.

It has been reported that the function of binding to FKBPs, cyclophilins or similar receptor proteins in a molecule can confer advantages including pharmacokinetic advantages —see e.g. Marinec et al., 2009. This paper reports that adding an FKBP binding motif to a HIV-1 protease inhibitor partitioned the drug into blood cells and extended its half-life. Additionally, the size of the receptor protein could potentially make inhibition of the target protein more effective than if just a small molecule NP were used.

The selection system described herein may be used to select for binding to one target preferentially against another, such as fungal calcineurin vs human calcineurin, or FKBP12 vs FKBP52 by using two reporter genes and two Target domains. This may be achieved, for example, by using one reporter gene for one target e.g. fungal calcineurin and one reporter gene for another target e.g. human calcineurin.

A generic description of the selection system is given below:

The selection system consists of three parts (see FIG. 10), which should be present in the cells containing the library of PKS genes. These are:
1. The Retained binding domain, which is, for example, linked to a DNA binding domain or a transcription activation domain.
2. The Target domain, which is, for example, linked to the other of either the DNA binding domain or the transcription activation domain.
3. The reporter gene In the splicing embodiment (see FIG. 20), the reporter gene can replaced by spliceable parts of a reporter.

These three elements are transformed into a cell, which is then further transformed with a library of PKS or NRPS genes (generated, for example using the methods described herein whereby hybrid PKSs and NRPSs are prepared wherein modules are inserted or deleted at hotspots selected from Junction region 1, Junction region 2 and Junction region 3), or pre-existing PKS genes in the cell are subjected to genetic manipulation to generate diversity (such as mutagenesis or the methods described in VO2015/004458). When the Retained binding domain and Target domain are joined by a PK or NRP produced by a cell in the library, the reporter gene is transcribed. This transcription can be selected for, for example by using an antibiotic, or a FACS cell sorter.

Examples within this document describe use of a rapamycin gene cluster-containing cell (*Streptomyces rapamycinicus*), where the iapB gene is replaced by a library of rapB genes, leading to a library of calls producing rapamycin analogues. rapB codes for a PKS gene which carries out the biosynthesis of the mTOR binding region of rapamycin. The other (retained) genes lead to biosynthesis of the FKBP binding region. It is obvious to one skilled in the art that the generic examples and specific examples within this document could be used to design a similar system for any PKS.

Throughout the text, where we refer to PK or PKS, it is obvious to one skilled in the art, that these could be replaced by NRP or NRPS, as modular non-ribosomal peptides have a similar organisation and binding capacity. An example of an NRP which could be used for this is cyclosporine A, which binds cyciophilin and calcineurin. By generating a library of cells producing analogues of cyclosporine A, which retain the cyclophilin binding domain, but have an altered calcineurin binding domain, one could use the selection system described here to select for cells producing cyclosporine A analogues which bind to cyclophilin and another target protein domain, or Target domain.

It will be obvious to one skilled in the art that the disclosures in this document can be combined with other methods of generating diversity, such as those disclosed in WO2015/004458. This would allow selection of cells in the three-hybrid selection system containing diversity generated by other methods, such as that disclosed in WO2015/004458 (incorporated herein by reference in its entirety).

WO2015/004458 discloses a process for producing a library of two or more mutant modular polyketide synthase encoding cells which express mutant functional polyketide synthases having an increased or reduced number of modules and which have been formed by recombination events which process comprises the steps of (i) contacting a modular polyketide synthase encoding strain of cells with a vector which includes a selectable marker and a portion of DNA homologous to a portion of DNA within the polyketide synthase such that the vector integrates into cells of the strain via a single crossover event;

(ii) applying selective pressure to the cells into which the vector has been integrated so that the cells eliminate the selectable marker through one or more recombination events; and (iii) screening for or selecting two or more cells that lack the selectable marker and which express mutant functional polyketide synthases having an increased or reduced number of modules.

The methods of the invention have the advantage that they enable selection of small molecule polyketides against a target, as opposed to screening isolated or partially isolated polyketides for binding in vitro. The methods for library generation have the advantage that they are more consistently productive than previously described junctions. The methods described herein generate PK-based small molecules which potentially have a number of advantages when compared to both synthetic small molecules and mAb biologics, including simpler and more rapid development and discovery, potential for oral bioavailability, reduced cost of goods due to simple fermentation, lower molecular weight and potential for improved cell permeability.

Examples

General Methods

Media

| 2TY | |
|---|---|
| Yeast extract | 10 g/L |
| Tryptone | 16 g/L |
| Sodium Chloride | 5 g/L |

| R6 conjugation media. For 700 ml | |
| --- | --- |
| Sucrose | 200 g |
| Dextrin | 10 g |
| Casamino acids | 1 g |
| $MgSO_4 \cdot 7H_2O$ | 0.05 g |
| $K_2SO_4$ | 0.1 g |
| Trace Elements | 1 mL (1 g/L each of $FeSO_4 \cdot 7H_2O$, $MnCl_2 \cdot 4H_2O$, $ZnSO_4 \cdot 7H_2O$, sterilized by filter and store at room temperature). |
| Agar | 20 g |

Autoclaved at 121 C, 20 minutes.

Sterile additions (added to 700 mL of well-tempered mixture prepared as above)

| | |
| --- | --- |
| 0.65M L-glutamic acid, mono sodium salt | 100 mL (filter sterilised) |
| 0.48M $CaCl_2 \cdot 2H2O$ | 100 mL |
| 0.1M MOPS pH 7.2 | 100 mL |

Plates are poured (~30 mL) and dried extensively in a laminar flow hood before use

| ISP3 Agar | |
| --- | --- |
| Oatmeal | 20 g/L |
| Bacto Agar | 18 g/L |
| Trace element solution | 1 mL/L (1 g/L each of $FeSO_4 \cdot 7H_2O$, $MnCl_2 \cdot 4H_2O$, $ZnSO_4 \cdot 7H_2O$, sterilized by filter and stored at room temperature). |

Oatmeal is cooked/steamed in the water for 20 min, strained through a muslin and more water added to replace lost volume. Trace elements solution is added and pH adjusted to 7.2 with NaOH. Agar is added before autoclaving at 121° C., 15 minutes.

| MAM Agar | |
| --- | --- |
| Wheat Starch | 10 g/L |
| Corn steep powder | 2.5 g/L |
| Yeast extract | 3 g/L |
| $CaCO_3$ | 3 g/L |
| $FeSO_4$ | 0.3 g/L |
| Adjust to pH 5.8 if needed before sterilisation | |
| Agar | 20 g/L |

| YPAD | |
| --- | --- |
| Yeast extract | 10 g/L |
| Peptone | 20 g/L |
| Dextrose | 20 g/L |
| Adenine, hemisulphate | 100 mg/L |

| SC-Ura | |
| --- | --- |
| Ammonium sulphate | 5 g/L |
| Yeast nitrogen source without ammonium sulphate and amino acids | 1.67 g/L |
| Complete synthetic medium minus uracil (CSM-Ura; MP Biomedicals) | 0.83 g/L |
| Adenine, hemisulphate | 43.3 mg/L |
| Dextrose | 20 g/L |
| pH to 5.6 with NaOH | |

SC-Ura-agar
SC-Ura and 20 g/L of agar
Autoclaved at 121 C, 20 minutes.

| RapV7 Seed medium | |
| --- | --- |
| Toasted Nutrisoy (ADM Ingredients Ltd) | 5 g/L |
| Avedex W80 dextrin (Deymer Ingredients Ltd) | 35 g |
| Corn Steep Solids (Sigma) | 4 g |
| $(NH_4)_2SO_4$ | 2 g |
| Lactic acid (80%) | 1.6 mL |
| $CaCO_3$ (Caltec) | 7 g |

Adjust pH to 7.5 with 1 M NaOH.
The media was then sterilised by autoclaving 121° C., 20 min.
d-Glucose (to 10 g/L) was added after autoclaving.

| MD6-plates medium Component Per L | |
| --- | --- |
| Toasted Nutrisoy (ADM Ingredients Ltd) | 30 g |
| Avedex W80 dextrin (Deymer Ingredients Ltd) | 19 g |
| Corn starch | 30 g |
| Yeast (Allinson) | 3 g |
| Corn Steep Solids (Sigma) | 1 g |
| $KH_2PO_4$ | 2.5 g |
| $K_2HPO_4$ | 2.5 g |
| $(NH_4)_2SO_4$ | 10 g |
| NaCl | 5 g |
| $CaCO_3$ (Caltec) | 10 g |
| $MnCl_2 \cdot 4H_2O$ | 10 mg |
| $MgSO_4 \cdot 7H_2O$ | 2.5 mg |
| $FeSO_4 \cdot 7H_2O$ | 120 mg |
| $ZnSO_4 \cdot 7H_2O$ | 50 mg |
| MES | 21.2 g |
| Agar | 30 g |

Medium was adjusted to pH6.0, 0.4 mL/L α-amylase (Sigma A7595-liquid, >250 units/g) added and the media sterilised for 30 min at 121° C. d-Fructose (to 20 g/L) and l-lysine (monohydrochloride) (to 2 g/L) were added after autoclaving.

| MD6 medium (Small scale fermentation medium) Component Per L | |
| --- | --- |
| Toasted Nutrisoy (ADM Ingredients Ltd) | 30 g |
| Avedex W80 dextrin (Deymer Ingredients Ltd) | 19 g |
| Corn starch | 30 g |
| Yeast (Allinson) | 3 g |
| Corn Steep Solids (Sigma) | 1 g |
| $KH_2PO_4$ | 2.5 g |
| $K_2HPO_4$ | 2.5 g |
| $(NH_4)_2SO_4$ | 10 g |
| NaCl | 5 g |
| $CaCO_3$ (Calcitec or Sigma) | 10 g |
| $MnCl_2 \cdot 4H_2O$ | 10 mg |
| $MgSO_4 \cdot 7H_2O$ | 2.5 mg |
| $FeSO_4 \cdot 7H_2O$ | 120 mg |
| $ZnSO_4 \cdot 7H_2O$ | 50 mg |
| MES | 21.2 g |

Medium was adjusted to pH8.0, 0.4m/L,-amylase (Sigma A7595-liquid, >250 units/g) added and the media sterilised for 30 min at 121° C. d-Fructose (to 20 g/L) and L-lysine (monohydrochioride) (to 2 g/L) were added after autoclaving.

Materials

All molecular biology enzymes and reagents are from commercial sources.

Bacterial Strains, Plasmids and Growth Conditions Eschedchia coli DH10B (GibcoBRL) Is grown in 2TY medium or 2TY agar media as described by Sambrook et al. (1989) and *E. coli* ET12567(pUZ8002) as described in Paget et at. (1999) in 2xTY medium with kanamycin (25 pg/ml) and chloramphenicol (10 pg/ml). *E. coli* transformants are typically selected for with either 100 pgImL ampicillin or 50 pg/mL apramycin depending on resistance marker. pGP9 is an expression plasmid described in described in Andexer et al., 2011 and Kuscer et al., 2007. pG9m-2 is available from Gen9, the sequence is deposited help.gen9blo.com/docs/pg9m-2-vector-map.

*Streptomyces* rapamycinicus and its derivatives are maintained on ISP3 agar plates or MAM agar plates at 28° C. Where necessary for selection apramycin is used at 50 pg/mL Spore stocks of these strains are prepared by growth on ISP3 agar medium for approximately 14-21 days and preserved in 20% w/v glycerol in distilled water at −80° C. Streptomyves rapamycinicus ISOM-3410 is a derivative of *Streptomyces hygroscopicus* NRRL5491 which had been subjected to classical strain and process development and capable of robust rapamycin production (Kendrew et al., 2013)—where employed in the Examples it could be replaced by *Streptomyces hygroscopicus* NRRL5491 or any other similar strain with rapamycin- or rapamycin-analogue PKS.

Yeast Strain and Growth Condition

*Saccharomyces cerevisiae* BY4741 (GE Dharmacon) is grown in YPAD or SC-Ura or SC-Ura agar at 30° C. according to standard methods (Adams et al, 1997).

Isolation of Genomic DNA

For PCR-ready genomic DNA prep FastDNA Spin Kit for Soil by MP Biomedicals Is used. A loopfull of culture of *Streptomyces* grown on solid agar was mixed wth 978 uL of included sodium phosphate buffer and 122 uL MT buffer. The sample was vortexed for 40 seconds, and centrifuged for 10 minutes at 14000 g to pellet debris. The supernatant was transferred to a clean microcentrifuge tube and 250 uL of PPS solution was added and mixed 10 times. The sample was centrifuged or 5 minutes at 14000 g to pellet the precipitate. The supernatant was transferred to 15 mL falcon tube and 1 mL of resuspended Bindign Matrix Solution was added. The sample was inverted for 2 minutes and placed on a rack to settle for 3 minutes. 500 uL of top supernatant was discarded. 600 uL of DNA solution was transferred to SPIN™ Filter Tube and the tube was centrifuged for 1 minute at 14000 g. The step was repeated until all material was transferred. The catch tube was emptied. 500 uL of prepared SEWS-M Solution was added and centrifuged as above, and then the catch tube was emptied. The tube was centrifuged for 2 minutes at 14000 g to remove any residual solution. The tube was air dried for 5 minutes at room temperature, and finally the 100 uL of water was used for elution of the DNA (with final centrifugation step was 1 minute at 14000 g). The eluted DNA solution was confirmed by 1% agarose gel electrophoresis in 0.5x TBE system and stored at −20° C. until needed.

DNA Manipulation and Sequencing

DNA manipulations, PCR and electroporation procedures are carried out as described in Sambrook et al. (1989). Automated DNA sequencing and DNA synthesis was carried out at a contract service provider, such as Invitrogen or the University of Cambridge. When codon optimization has been applied to adapt the codon usage to actinomycetes, JCet algorithm was applied (*Nucleic Acids Res.* 2005 Jul. 1; 33(Web Server issue):W526-31). Synthatic DNA was ordered from Gen9 (gen9bio.com),Life Technologies/ThermoFisher Scientific (thermofisher.com) or integrated DNA Technologies (eu.idtdna.com/site).

Conjugation of *Streptomyces Rapamycinicus*

*Escherichia coli* ET12587, harbouring the plasmid pUZ8002 was transformed with the desired plasmid by electroporation to generate the *E. coli* donor strain for conjugation. This strain was used to transform *Streptomyces rapamycinicus* by spore conjugation as described below. Fresh spores were harvested in water or 20% glycerol from plates of *Streptomyces* rapamycinicus. Alternatively frozen spore stocks were used. These spores were washed in 2TY and then resuspended in 0.25 ml 2TY and were heat-shocked at 50° C. for 10 minutes in a water bath. These were then mixed with the E. cof donor strain which had been grown (with appropriate antibiotics) to an optical density of approximately 0.4 and washed twice with 2TY before resuspending in 0.25 ml 2TY. The mixture of strains was plated onto R6 medium and incubated at 37° C. (for plasmids with pKC1139 background). After 2-3 hours the plates were overlaid with naldixic acid (final in-plate concentration 25 pg/mL) and after a further 18 hours to select for the incoming antibiotic resistance marker, such as with apramycin sulphate (final in-plate concentration 50 pg/mL), kanamycin, hygromycin, viomycin, thiostrepton, spectinomycin or erythromycin.. For conjugation of plasmids to an attachment site conjugation plates were incubated at 28° C. overnight before and overlaying sequentially with first nalidbdc acid (final in-plate concentration 25 pg/mL) and then to select for the incoming antibiotic resistance marker, such as with apramycin sulphate (final in-plate concentration 50 pg/mL), kanamycin, hygromycin, viomycin, thiostrepton, spectinomycin or erythromycin.

Conjugation of *Streptomyces* Rapamycinicus Version 2

Briefly, the *E. coli-Streptomyces* shuttle plasmid is electroporated into ET12567:pUZ8002 and selected on 2TY agar medium containing appropriate selection antibiotic for the incoming marker (e.g. apramycin at 50 pg/mL), kanamycin (25 pg/mL), and chloramphenicol (25 pg/mL). Single colonies are grown overnight in 5 ml 2TY liquid medium containing appropriate selection antibiotic for the incoming marker (e.g. apramycin at (50 pg/mL), kanamycin (25 pg/mL) and chloramphenicol (25pg/ml). 1 ml of this culture is used to inoculate 10 ml liquid medium containing appropriate selection antibiotic for the incoming marker (e.g. apramycin at (50 pg/mL), kanamycin (25pg/ml) and chkoramphenlcol (25 pg/mL) and grown at 37 C to reach an OD of 0.4-0.6. Cells were pelleted at 4000 rpm for 10 minutes and washed twice with 10 ml 2TY before resuspending in 0.5 mL 2TY. Spores of *S. hygroscopicus* ISOM-5032 grown on MAM for 2 weeks are harvested using 20% glycerol and stored at −80° C. (1 plate gives about 1 mL spore stock). For the conjugation approximately 0.5 mL of these spores are needed for each conjugation. Spores were unfrozen and pelleted by centrifugation (4000 rpm, 10 minutes) before washing with 2TY. The spores are then repelleted and resuspended in 0.25 mL 2TY and heat shocked in a water bath at 50° C. for 10 minutes before cooling immediately on ice. The conjugation is performed by adding 0.25 mL of washed E. cocl cells to the heat shocked spores, mixing and spreading the mixture onto a R8 plate and transferring to 37° C. The plate is overlaid with 2 mL water containing 15 pL nalidixic acid (stock 50 mg/mL) and, subsequently, with 2 mL water containing appropriate selection antibiotic for the incoming marker (e.g. apramycin 15 uL of a 100 mg/mL stock) after an overnight incubation. Plates are incubated at 28° C. until single exconjugant colonies are visible. Colonies (approximately 10) were patched to MAM containing selection for the incoming marker and nalidbdc acid and reincubated at 28° C. Usually this colony was then repatched to the same media (containing selection for the incoming marker and nalidixic acid) to ensure there was no E. coi contamination before plating to MAM and leaving at 28° C. for to allow the strain to sporulate (~10-14 days). The exconjugant strains are tested by PCR to confirm they now contain the incoming genes of interest Analytical Fermentation Production of rapamycin analogues and contracted rapamycins is carried out by fermentation of *Streptomyces rapamycinicus*. Typically strains are grown on ISP3 agar at 28° C. for 10-14 days to achieve good sporulation and are used to inoculate 7 ml seed medium RapV7 (50 mL polypropylene centrifuge tubes (falcon tubes) (cat no.227261, purchased from Greiner Bio-One Ltd, Stonehouse, Gloucestershire, UK)) closed with foam plugs by transferring an agar plug (5 mm diameter). Alternatively 35 pL of a thawed spore stock is used for the inoculation. The inoculated seed medium is incubated with shaking at 300 rpm, 2.5 cm throw at 28° C. for 48 hours. For production the fermentation medium MD6 (7 mL in falcon tube as before) Is inoculated with 0.5 mL of the seed culture using a wide bore tip and incubated with shaking at 300 rpm, 2.5 cm throw at 26° C. for six days. The culture is then harvested for extraction. A selected starter unit feed (corresponding to the desired starting unit for biosynthesis of the target compound) is fed to the production medium 24 hours post inoculation. Typically feed is dissolved in methanol (0.05 mL) and added to culture to give final concentration of 2 mM. The broth is extracted by aliquoting 0.9 ml into an eppendorf tube (2 m) and adding methanol (0.9 ml). The eppendorf is then shaken on a vibrax bed for 30 minutes before the cell debris was removed by centrifugation (13,200 rpm, 10 minutes). An aliquot of the supernatant is then transferred to an LC-vial for analysis by the methods described below.

Preparative Fermentation

Spore stocks of the strains for fermentation ae prepared after growth on ISP3 agar medium and preserved in 20% w/v glycerol in distilled water and stored at −80° C. Spore stocks are recovered onto plates of MAM or ISP3 medium and incubated for 10-11 days at 28° C. Vegetative cultures (seed cultures) are prepared using working spore stocks of at 0.05% inoculum and inoculating into 400 ml medium RapV7 in 2 litre Erlenmeyer flasks with foam plugs. Cultivation is carried out for 48 hours at 28° C., 250 rpm (2.5 cm throw). The entire seed culture in one flask is transferred into 15 litres of medium MD6/5-1 pre-adjusted at pH 6.0-7.0 in a fermenter. The fermentation is carried out for 6 days at 28° C., with starting agitation at 200 rpm, aeration rate at 0.5 VN/M and dissolved oxygen (DO) level controlled with the agitation cascade at 30% air saturation. The starting agitation is set at 200 rpm. For production of compound, the selected precursor to feed (starting unit for biosynthesis of target compound) is fed to the production medium 24 hours post inoculation. Feed is dissolved in 3 mL to 5 mL methanol and added to the culture to give final concentration of 2 mM of the feed compound. The amount of methanol does not exceed 1% of the total volume. Fermentation is continued for further five days post-feeding, before harvesting. Harvested whole broth is centrifuged at 3500 rpm (RCF 3300g) for 25 mins. The clarified broth is assayed and discarded if less than 5% target compound detected. The cell pellet is removed from the centrifuge pots with acetonitrile and decanted into a 10L glass duran. Further acetonitrile is added to give a ratio of 2 volumes of solvent to 1 volume of cells. The mixture is then stirred for 1 hour using an overhead electric paddle stirrer at 600 rpm. After 1 hour the stirring is stopped and the mixture left to settle under gravity for 15 mins. The solvent layer is removed as extract_1 and a further 2 volumes of acetonitrile added to the remaining cells. This is stirred again as above to obtain extract_2. Any remaining compounds in the cell pellet can be removed by a third extraction if required. Any target compound in the clarified broth can be recovered by adding an equal volume of ethyl acetate and stirring for 1 hour in a glass duran using an overhead electric paddle stirrer at 600 rpm. The organic solvent is then separated by centrifugation at 3500 rpm (RCF 3300g) for 15 mins. The combined extracts from both the cell pellet and, if required clarified broth, are concentrated in vacuo to a residual aqueous extract which is then extracted into an equal volume of ethyl acetate. A second ethyl acetate extraction can be performed as necessary. The ethyl acetate extract containing the target compound is then concentrated in vacuo to yield a final often oily crude. The crude extract is dissolved in methanol, and silica gel added (approximately equal amount to the extract by weight) and the solvent removed in vacuo to a free-flowing powder. The impregnated silica is loaded on to a silica gel column (20×5 cm) and eluted with 100% CHCIs, and gradually increases polarity by adding MeOH (to a maximum 5% MeOH). Approximately 20×250 ml fractions are collected and monitored by TLC and analytical HPLC. The fractions containing the compounds are loaded onto a second silica gel column (15×2 cm) and eluted with a mixture of hexane and ethyl acetate (1:1). First 1L of (1:1) mixture is passed through, then 1L of (40:60), and continued to 100% of EtOAc. Approximately 20×250 mL fractions are collected and individually checked by tlc and analytical HPLC. Fractions found to contain compounds are combined and the solvents were removed in vacuo. This bulk is then dissolved in acetonitile and multiple injections (about 100 mg crude per injection) made to preparative HPLC using a water acetonitrile gradient mixture for 30 minutes (actual methods depend on compound polarity). The solvent from the resulting pure compound containing fractions is removed in vacua and the compound analysed by LC-MS and NMR for characterisation.

NMR Structure Elucidation Methods

NMR spectra are recorded on a Bruker Advance 500 spectrometer at 298 K operating at 500 MHz and 125 MHz for $^1$H and $^{13}$C respectively. Standard Bruker pulse sequences are used to acquire $^1$H-$^1$H COSY, APT, HMBC and HMQC spectra. NMR spectra are referenced to the residual proton or standard carbon resonances of the solvents in which they are run.

Assessment of Compound Purity

Purified compounds are analysed using LCMS method described. LCMS method: chromatography is achieved over a Phenomenex HyperClone $C_1$-BDS column (4.6×150 mm, 3 micron particle size) eluting with a gradient of water+0.1% formic acdd:acetonitrile+0.1% formic acid, (90:10) to (0:100), at 1 mLUmin over 20 min. Purity is assessed by MS and at multiple wavelengths (210, 254 & 278 nm). All compounds are >95% pure et all wavelengths. Purity Is finally confirmed by inspection of the $^1$H NMR spectra.

Example 1: Generation of a Small Test Rapamycin-Based Diversity Library Using Type IIS Restriction Enzyme Cloned Junctions The rapamycin PKS consists of 18 modules, encoded by four genes (see FIG. 11). In this experiment, novel rapamycin analogues are generated by complementing a rapB gene knockout, which encodes modules 5-10, with a synthetic gene generated by combining module-encoding sequences (see FIG. 1 for overview). Junctions between these modules were designed using the recombination 'hotspots' disclosed in this document Plasmid pDiv1-001, containing part of rapB that allows insertion of module-encoding sequences at Junction region 3, is obtained as follows: plasmid pRR0, containing the synthetic DNA sequence SEQ ID NO 1 ligated into sites Asti (1981) and Aal (2087) of pG9m-2 (Gen9 Bio.) is linearised by digestion with the restriction enzyme Sapl. Plasmid pRR01, containing synthetic DNA sequence SEQ ID NO 2 ligated into sites Awrl (1961) and Asti (2087) of pG9m-2 (Gen9 Blo.), is digested with restriction enzyme Sapl, resulting in a 3495 bp fragment. Plasmid pRR07, containing synthetic DNA sequence SEQ ID NO 3 ligated into sites Awl (1981) and Aarl (2087) of pG9m-2 (Gen9 Bio.), is digested with restriction enzyme Sepl, resulting in a 2427 bp fragment Plasmid pRR02, containing synthetic DNA sequence SEQ ID NO 4 ligated into sites Aarl (1981) and Aati (2067) of pG9m-2 (Gen9 Blo.), Is digested with restriction enzyme Sapl, resulting in a 2637 bp fragment. Plasmid pRR03, containing synthetic DNA sequence SEQ ID NO 5 ligated into sites Aarl (1981) and Aarl (2067) of pG9m-2 (Gen9 Bio.), is digested with restriction enzyme Sapl, resulting in a 3495 bp fragment. Plasmid pRR04, containing synthetic DNA sequence SEQ ID NO 8 ligated into sites Aarl (1961) and Astl (2087) of pG9m-2 (Gen9 Bio.), Is digested with restriction enzyme Sapl, resulting in a 3495 bp fragment. Plasmid pRR05, containing synthetic DNA sequence SEQ ID NO 7 ligated into sites Astl (1981) and Awri (2087) of pG9m-2 (Gen9 Bio.), is digested with restriction enzyme Sapl, resulting in a 3495 bp fragment. The DNA of Sapl-digested fragments from pRR0, pRR01, pRR07, pRR02, pRR03, pRR04 and pRR05 (SEQ ID NO 1, SEQ ID NO 2, SEQ ID NO 3, SEQ ID NO 4, SEQ ID NO 5, SEQ ID NO 6 and SEQ ID NO 7) are then assembled using the InFusion cloning kit (Clontech) following the manufacturer's instructions. The reaction mixture is used to transform Stellar chemically competent E. coli cells (Clontech) following the manufacturer's instructions, with selection for ampicillin resistance. The resulting plasmid, pRR0b is isolated and confirmed by restriction digestion. Plasmid pRR0b is then digested with Ndel and Xbal, resulting in a 19,827 bp fragment, and ligated with pAWD33, also digested with Ndel and Xbal, to produce the final plasmid pDiv1-001.

Plasmid pDlv1-002, another plasmid containing part of rapB that allows insertion of module-encoding sequences at Junction region 1, is obtained as follows: pRR0, containing the synthetic DNA sequence SEQ ID NO1 ligated into sites Awd (1981) and Aal (2087) of pG9m-2 (Gen9 Bio.) is linearised by digestion with the restriction enzyme Sapl. Plasmid pRR02, containing synthetic DNA sequence SEQ ID NO 4 ligated into sites Awl (1961) and Aal (2067) of pG9m-2 (Gen9 Blo.), Is digested with restriction enzyme Sapl, resulting in a 2637 bp fragment Plasmid pRR03, containing synthetic DNA sequence SEQ ID NO 5 ligated into sites Aal (1961) and Aal (2087) of pG9m-2 (Gen9 Bio.), Is digested with restriction enzyme Sapl, resulting in a 3495 bp fragment Plasmid pRR04, containing synthetic DNA sequence SEQ ID NO 6 ligated into sites Awd (1961) and Aal (2067) of pG9m-2 (Gen9 Bio.), is digested with restriction enzyme Sapl, resulting in a 3495 bp fragment Plasmid pRR05, containing synthetic DNA sequence SEQ ID NO 7 ligated into sites Aal (1961) and Aal (2087) of pG9m-2 (Gen9 Bio.), is digested with restriction enzyme Sapl, resulting in a 3495 bp fragment Plasmid pRR08, containing synthetic DNA sequence SEQ ID NO 8 ligated into sites Aarl (1981) and Awl (2067) of pG9m-2 (Gen9 Blo.), is digested with restriction enzyme Sapl, resulting in a 1137 bp fragment. The DNA of Sapl-digested fragments from pRR0, pRR02, pRR03, pRR04, pRR05, pRR06 (SEQ ID NO 1, SEQ ID NO 4, SEQ ID NO 5, SEQ ID NO 6, SEQ ID NO 7 and SEQ ID NO 8) are assembled using the InFusion cloning kit (Clontech) following the manufacturer's Instructions. The reaction mixture is used to transform Stellar chemically competent E. coli cells (Clontech) following the manufacturer's instructions, with selection for ampicillin resistance. The resulting plasmid, pRR0c Is isolated and confirmed by restriction digestion. Plasmid pRR0c is then digested with Nde/and Xbal, resulting in a 15,054 bp fragment, and ligated with pAW033, also digested with Ndel and Xbal, to produce the final plasmid pDiv1-002.

Plasmid pDiv1-003, containing the sequence encoding module 8 of rapB such that it can be inserted into the junction site of pDiv1-001, is obtained as follows: plasmids pRR12, containing synthetic DNA sequence SEQ ID NO 9 ligated into sites Aal (1961) and Aal (2087) of pG9m-2 (Gen9 Blo.), pRR08, containing synthetic DNA sequence SEQ ID NO 10 ligated into sites Awl (1981) and Aal (2067) of pG9m-2 (Gen9 Bio.) and pRR09, containing synthetic DNA sequence SEQ ID NO 11 ligated into sites Aal (1961) and Awd (2087) of pG9m-2 (Gen9 Bio.), are combined into a single reaction vessel, containing restriction enzyme Sapl and $T_4$ DNA ligase in $T_4$ DNA ligase buffer. This reaction mixture is incubated at 37° C. for 5 hours, 50° C. for 5 minutes and 80° C. for 10 minutes and then used directly to transform electrocompetent E. coli DH10B by electroporation with selection for ampicillin resistance. The resulting plasmid, pDiv1-003, is then isolated and confirmed by restriction digestion.

Plasmid pDiv1-004, containing the sequence encoding module 8 of rapB such that it can be inserted into the junction site of pDiv1-002, Is obtained as follows: plasmids pRR09, containing synthetic DNA sequence SEQ ID NO 11 ligated into sites AMr (1981) and Aal (2067) of pG9m-2 (Gen9 Blo.), pRR10, containing synthetic DNA sequence SEQ ID NO 12 ligated into sites Aad (1961) and Aa1 (2067) of pG9m-2 (Gen9 Blo.) and pRR11, containing synthetic DNA sequence SEQ ID NO 13ligated into sites Aarl (1961) and Aal (2067) of pG9m-2 (Gen9 Bio.), are combined into a single reaction vessel, containing restriction enzyme Sapl and $T_4$ DNA ligase in $T_4$ DNA ligase buffer. This reaction mixture is incubated at 37° C. for 5 hours, 50° C. for 5 minutes and 80° C. for 10 minutes and then used directly to transform electrocompetent E. coli DH10B by electroporation with selection for ampicillin resistance. The resulting plasmid, pDiv1-004, is then isolated and confirmed by restriction digestion.

A small library of rapB variants is obtained by combining pDiv1-001 and pDiv1-003 in a single reaction vessel containing restriction enzyme Bael and $T_4$ DNA ligase in $T_4$ DNA ligase buffer. This reaction mixture is incubated at 25° C. for 5 hours, 50° C. for 5 minutes and 80° C. for 10 minutes. The reaction mixture is then used directly to transform *E. coli* DH10B by electroporation with selection for hygromycin resistance.

A small library of rapB variants is obtained by combining pDiv1-002 and pDiv1-004 in a single reaction vessel containing restriction enzyme BaeI and $T_4$ DNA ligase in $T_4$ DNA ligase buffer. This reaction mixture is incubated at 25° C. for 5 hours, 50° C. for 5 minutes and 80° C. for 10 minutes. The reaction mixture is then used directly to transform *E. coli* DH10B by electroporation with selection for hygromycdn resistance.

Either of the two libraries described above can be used to transform conjugation strain ET12567 carrying plasmid pUZ8002. Contrary to regular transformation the cells are not plated out onto agar. Instead they are used as a starter culture for conjugation, replacing the overnight culture described in the procedure above (see general methods). These can be used to conjugate S.rapamycdircus selection strains such as ISOM-5033.

Example 2: Generation of a small test rapamycin-based library using *Saccharomyces cerevisiae* in vlvo homologous recombination of cloned naye junctions In this alternative to the experiment described in example 1, the junctions described are used to design an experiment which utilises yeast recombinatlon to join DNA encoding PKS modules. Novel rapamycin analogues are again generated by complementing a rapB gene knockout, which encodes modules 5-10, with a synthetic gene generated by combining module-encoding sequences from rapB and rapC (see FIG. 7A for overview). Junctions between pDJA17, rapB and rapC modules were designed using native sequence (see FIG. 7B) and using the recombination 'hot-spots' disclosed in this document and allow for varied order of module insertion.

Plasmid pDIv001-5, containing part of rapB that allows insertion of module-encoding native sequences, is obtained as follows: plasmid pRR0, containing the synthetic DNA sequence SEQ ID NO 1 ligated into sites AarI (1981) and AarI (2067) of pG9m-2 (Gen9 Blo.) is linearised by digestion with the restriction enzyme Sapl. Plasmid pRR01, containing synthetic DNA sequence SEQ ID NO 2 ligated into sites AarI (1981) and AarI (2067) of pG9m-2 (Gen9 Bio.), Is digested with restriction enzyme Sapl, resulting in a 3495 bp fragment Plasmid pRR02, containing synthetic DNA sequence SEQ ID NO 4 ligated into sites AarI (1981) and AarI (2087) of pG9m-2 (Gen9 Blo.), is digested with restriction enzyme Sapl, resulting in a 2637 bp fragment. Plasmid pRR03, containing synthetic DNA sequence SEQ ID NO 5 ligated into sites AarI (1961) and-AarI (2087) of pG9m-2 (Gen9 Bio.), is digested with restriction enzyme Sapl, resulting in a 3495 bp fragment. Plasmid pRR04, containing synthetic DNA sequence SEQ ID NO 8 ligated into sites AarI (1961) and AarI (2087) of pG9m-2 (Gen9 Blo.), is digested with restriction enzyme Sepl, resulting in a 3495 bp fragment Plasmid pRR05, containing synthetic DNA sequence SEQ ID NO 7 ligated into sites AarI (1961) and AarI (2067) of pG9m-2 (Gen9 Bio.), is digested with restriction enzyme Sapl, resulting in a 3495 bp fragment Plasmid pDJA10, containing synthetic DNA sequence SEQ ID NO 14 ligated into sites AMl (1961) and AarI (2087) of pG9m-2 (Gen9 Bio.), Is digested with restriction enzyme Sapl, resulting in a 2592 bp fragment the DNA of SapI-digested fragments from pRR0, pRR01, pRR02, pRR03, pRR04, pRR05 and pDJA10 (SEQ ID NO 1, SEQ ID NO 2, SEQ ID NO 4, SEQ ID NO 5, SEQ ID NO 8, SEQ ID NO 7 and SEQ ID NO 14) are then assembled using the InFusion cloning kit (Clontech) following the manufacturer's instructions. The reaction mbdure is used to transform Stellar chemically competent E. coi cells (Clontech) following the manufacturer's instructions, with selection for ampicillin resistance. The resulting plasmid, pDJA17 is isolated and confirmed by restriction digestion. Plasmid pDJA17 is then digested with Ndel and Xbal, resulting in a 19,992 bp fragment, and ligated with pAW033, also digested with Ndel and XbaI, to produce the plasmid pDJA18. pDJA18 is digested with Asel and a PCR product generated from pRS416 template (ATCC 87521) and oligo primers with DNA sequences SEQ ID NOs15 and 18 inserted using InFusion cloning kit (Clontech) to generate the final plasmid pDiv001-5.

Plasmid pDJA20, containing assembled native rapB module 6, is obtained as follows: plasmid pDJA19 is created by phosphorylation, annealing and ligation of ollgo primers SEQ ID NOs 20-23 with Hindlll/Xbal cut pKC1132. Plasmid pDJA01, containing the synthetic DNA sequence SEQ ID NO 17 ligated into sites AMl (1981) and Aarl (2087) of pG9m-2 (Gen9 Bio.) is linearised by digestion with the restriction enzyme Sapl, resulting in a 3502 bp fragment Plasmid pDJA02, containing the synthetic DNA sequence SEQ ID NO18 ligated into sites Aarl (1961) and Aarl (2067) of pG9m-2 (Gen9 Bo.) is linearised by digestion with the restriction enzyme Sapl, resulting in a 511 bp fragment. Plasmid pDJA03, containing the synthetic DNA sequence SEQ ID NO 19 ligated into sites AMl (1961) and AMd (2067) of pG9m-2 (Gen9 Bio.) is linearised by digestion with the restriction enzyme Sapl, resulting in a 1089 bp fragment. The DNA of Sepi-digested fragments from pDJA01-pDJA03 (SEQ ID NO 17, SEQ ID NO 18, SEQ ID NO 19) are then assembled with Bpml-digested pDJA19 using the InFusion cloning kit (Clontech) following the manufacturer's instructions. The reaction mixture is used to transform Stellar chemically competent *E. coli* cells (Clontech) following the manufacturer's instructions, with selection for apramycin resistance. The resulting plasmid, pDJA20 is isolated and confirmed by restriction digestion. Plasmid pDJA22, containing assembled native repC module 12, Is obtained as follows: plasmid pDJA21 Is created by phosphorylation, annealing and ligation of oligo primers SEQ ID NOs 24-27 with HindlllXbal cut pKC1132. Plasmid pDJA12, containing the synthetic DNA sequence SEQ ID NO 28 ligated into sites Aal (1961) and Awl (2067) of pG9m-2 (Gen9 Bio.) is linearised by digestion with the restriction enzyme Sapl, resulting in a 3364 bp fragment. Plasmid pDJA13, containing the synthetic DNA sequence SEQ ID NO 29 ligated into sites Aal (1961) and AMl (2067) of pG9m-2 (Gen9 Bio.) is linearised by digestion with the restriction enzyme Sapl, resulting in a 506 bp fragnent Plasmid pDJA14, containing the synthetic DNA sequence SEQ ID NO 30 ligated into sites Aal (1961) and AaM (2067) of pG9m-2 (Gen9 Bio.) is linearised by digestion with the restriction enzyme Sapl, resulting in a 1085 bp fragment the DNA of Sapl-digested fragments from pDJA12-pDJA14 (SEQ ID NO 28, SEQ ID NO 29, SEQ ID NO 30) are then assembled with Bpml-digested pDJA21 using the InFusion cloning kit (Clontech) following the manufacturer's instructions. The reaction mixture is used to transform Stellar chemically competent *E. coli* cells (Clontech) following the manufacturer's instructions, with selection for apramycin resistance. The resulting plasmid, pDJA22 is isolated and confirmed by restriction digestion. pDJA20 is cut with Sapl to liberate a 5078 bp fragment corresponding to rapB module 6. pDJA22 is cut with SapI to liberate a 4931 bp fragment corresponding to rapC module 12. Plasmid pDiv001-5 is cut with BeeI to remove the linker region. The restriction mixtures are resolved by agarose gel electrophoresis and gel slabs containing required DNA fragments excised and purified.

Saccharomyces cerevislae is transformed, positive clones selected and DNA extracted from clones as described in Shao and Zhao (2013). Standard yeast methods are described in Adams et al. (1997). In brief, 300 ng of each DNA is mixed in a tube, the final volume calculated and DNA precipitated using sodium acetate, glycogen and 100% ethanol. The DNA pellet is washed and resuspended in a total volume of 4 ul. A single colony of Saccharomyces cerevislae BY4741 is cultured in YPAD overnight the following morning an appropriate voluine of the culture is used to inoculate 50 ml YPAD to give an OD600 of 0.2 and grown until an OD600 of 0.8 is reached. Cells are pelleted and washed in ice-cold ddH20 and then ice-cold sorbitol. The final cel pellet is resuspended in ice-cold sorbitol and aliquots are used for electroporation. 4 ul of prepared DNA is mixed with 50 ul cells and electroporated at 1.5 kV. Pre-warmed (30° C.) YPAD is added to resuspend cells and grown at 30° C. for 1 hr. Cells are pelleted and washed in sorbitol 2-3 times and spread on SC-Ura plates and incubated at 30 C until single colonies appear. Single colonies are cultured in SC-Urm liquid medium and plasmid DNA purified using a Zymoprep II yeast plasmid miniprep kit (Zymo Research). Extracted DNA is pooled and is transformed in to *E. coli* DH10B by electroporation with selection for apramycin resistance. This library can be used to transform conjugation strain ET12567 carrying plasmid pUZ8002. Contrary to regular transformation the cells are not plated out onto agar. Instead they are used as a starter culture for conjugation, replacing the overnight culture described in the procedure above (see general methods). These can be used to conjugate strains such as *S. rapamycinlcus* ISOM-5032, ISOM-5033, ISOM-5034 or ISOM-5035.

Example 3: Generation of a Small Test Rapamycin-Based Library Using *Saccharomyces* Cereviisie in Vivm Homologous Recombination of Cloned Non-Native Junctions In this experiment, the junctions described in this document are used to design non-native junction regions that promote specific recombination cross-over between PKS encoding sequence. Again, novel rapamycin analogues are generated by complementing a rapB gene knockout, which encodes modules 5-10, with a synthetic gene generated by combining module-encoding sequences from rapB and rapC (see FIG. 7A for overview). Junctions between pDJA23, rapB and rapC modules were designed using non-native sequence (see FIG. 7C) and using the recombination 'hotspots' disclosed in this document. The non-native junction sequences contain introduced base changes that allow recombination between KS6-pDJA23 and KS6-module 6 but limit recombination between KS6-pDJA23 and KS12-module 12 or between KS6-pDJA23 and KS8-pDJA23. Similarly, recombination between KS7-module 6 and KS12-module 12 is allowed as is recombination between KS13-module 12 and KS8-pDJA23. Recombination between KS7-module 6 and KS8-pDJA23 Is limited as is recombination between KS13-module 12 and KS6-module 6. The non-native junctions permit insertion of module 6 and then module 12 (in that order) and illustrate the utility of engineered non-native junctions in generating larger ordered rational PKS libraries (see example 13 for a broader description).

Plasmid pDiv001-6, containing part of rapB that allows insertion of module-encoding non-native sequences, is obtained as follows: plasmid pRR0, containing the synthetic DNA sequence SEQ ID NO 1 ligated into sites AarI (1961) and AarI (2067) of pG9m-2 (Gen9 Blo.) is linearised by digestion with the restriction enzyme SapI. Plasmid pRR01, containing synthetic DNA sequence SEQ ID NO 2 ligated into sites AMr (1981) and AarI (2067) of pG9m-2 (Gen9 Bio.), is digested with restriction enzyme SepI, resulting in a 3495 bp fragment. Plasmid pRR02, containing synthetic DNA sequence SEQ ID NO 4 ligated into sites AMl (1961) and AwI (2067) of pG9m-2 (Gen9 Blo.), is digested with restriction enzyme SapI, resulting in a 2637 bp fragment Plasmid pRR03, containing synthetic DNA sequence SEQ ID NO 5 ligated into sites AarT (1961) and AaM (2067) of pG9m-2 (Gen9 Bio.), is digested with restriction enzyme SapI, resulting in a 3495 bp fragment Plasmid pRR04, containing synthetic DNA sequence SEQ ID NO 6 ligated into sites AarlI (1961) and AarI (2067) of pG9m-2 (Gen9 Blo.), is digested with restriction enzyme SapI, resulting in a 3495 bp fragment. Plasmid pRR0S, containing synthetic DNA sequence SEQ ID NO 7 ligated into sites AarI (1961) and AarI (2067) of pG9m-2 (Gen9 Bio.), is digested with restriction enzyme SapI, resulting in a 3495 bp fragment Plasmid pDJA11, containing synthetic DNA sequence SEQ ID NO 31 ligated into sites AMl (1961) and AMr (2067) of pG9m-2 (Gen9 Blo.), is digested with restriction enzyme SapI, resulting in a 2592 bp fragment the DNA of SapI-digested fragments from pRR0, pRR01, pRR02, pRR03, pRR04, pRR05 and pDJA11 (SEQ ID NO 1, SEQ ID NO 2, SEQ ID NO 4, SEQ ID NO 5, SEQ ID NO 6, SEQ ID NO 7 and SEQ ID NO 31) are then assembled using the InFusion cloning kit (Clontech) following the manufacturer's instructions. The reaction mixture is used to transform Stellar chemically competent *E. coli* cells (Clontech) following the manufacturer's instructions, with selection for ampicillin resistance. The resulting plasmid, pDJA23 is isolated and confirmed by restriction digestion. Plasmid pDJA23 is then digested with NdeI and XbaI, resulting in a 19,992 bp fragment, and ligated with pAW033, also digested with NdeI and XbaI, to produce the plasmid pDJA24. pDJA24 is digested with AseI and a PCR product generated from pRS416 template (ATCC 87521) and oligo primers with DNA sequences SEQ ID NOs15 and 16 inserted using InFusion cloning kit (Clontech) to generate the final plasmid pD1v001-6.

Plasmid pDJA25, containing assembled non-native rapB module 6, is obtained as follows: plasmid pDJA19 is created by phosphorylation, annealing and ligation of oligo primers SEQ ID NOs 20-23 with HindlllXbaI cut pKC1132. Plasmid pDJA01, containing the synthetic DNA sequence SEQ ID NOs17 ligated into sites AwtI (1961) and ArtI (2067) of pG9m-2 (Gen9 Blo.) is linearised by digestion with the restriction enzyme SapI, resulting in a 3502 bp fragment Plasmid pDJA02, containing the synthetic DNA sequence SEQ ID NOs18 ligated into sites Awri (1961) and Awri (2067) of pG9m-2 (Gen9 Bio.) is linearised by digestion with the restriction enzyme SapI, resulting in a 511 bp fragment Plasmid pDJA04, containing the synthetic DNA sequence SEQ ID NO 32 ligated into sites AarI (1961) and AwtI (2067) of pG9m-2 (Gen9 Bio.) is linearised by digestion with the restriction enzyme SapI, resulting in a 1089 bp fragment. The DNA of SapI-digested fragments from pDJA01, pDJA02 and pDJA04 (SEQ ID NO 17, SEQ ID NO 18, SEQ ID NO 32) are then assembled with Bpml-digested pDJA19 using the InFusion cloning kit (Clontech) following the manufacturer's Instructions. The reaction mixture is used to transform Stellar chemically competent *E. coli* cells (Clontech) following the manufacturer's Instructions, with selection for apramycin resistance. The resulting plasmid, pDJA25 is isolated and confirmed by restriction digestion.

Plasmid pDJA27, containing assembled non-native rapC module 12, is obtained as follows: plasmid pDJA26 is created by phosphorylation, annealing and ligation of oligo primers SEQ ID NOs 26, 27, 33 and 34 with Hindlll/Xbai cut pKC1132. Plasmid pDJA12, containing the synthetic DNA sequence SEQ ID NO 28 ligated into sites Aal (1961) and Arti (2067) of pG9m-2 (Gen9 Bio.) is linearised by digestion with the restriction enzyme Sapl, resulting in a 3364 bp fragment Plasmid pDJA15, containing the synthetic DNA sequence SEQ ID NO 35 ligated into sites Aad (1961) and Aarl (2067) of pG9m-2 (Gen9 Bio.) is linearised by digestion with the restriction enzyme Sapl, resulting in a 506 bp fragment. Plasmid pDJA16, containing the synthetic DNA sequence SEQ ID NO 36 ligated into sites Aal (1961) and Astl (2067) of pG9m-2 (Gen9 Bio.) is linearised by digestion with the restriction enzyme Sapl, resulting in a 1085 bp fragment the DNA of Sapl-digested fragments from pDJA12, pDJA15 and pDJA16 (SEQ ID NO 28, SEQ ID NO 35, SEQ ID NO 36) are then assembled with Bpml-digested pDJA26 using the InFusion cloning kit (Clontech) following the manufacturer's instructions. The reaction mixture is used to transform Stellar chemically competent *E. coli* cells (Clontech) following the manufacturer's instructions, with selection for apramycin resistance. The resulting plasmid, pDJA27 is isolated and confirmed by restriction digestion.

pDJA25 is cut with Sapl to liberate a 5078 bp fragment corresponding to non-native rapB module 6. pDJA27 is cut with Sapl to liberate a 4931 bp fragment corresponding to non-native rapC module 12. Plasmid pDiv001-6 is cut with Bael to remove the linker region. The restriction mixtures are resolved by agarose gel electrophoresis and gel slabs containing required DNA fragments excised and purified.

*Saccharomyces cerevisiae* is transformed, positive clones selected and DNA extracted from clones as described in Shao and Zhao (2013) and example 2. Plasmid DNA is transformed in to *E. coli* DH10B for library creation as described in example 2. This library can be used to transform conjugation strain ET12567 carrying plasmid pUZ8002. Contrary to regular transformation the cells are not plated out onto agar. Instead they are used as a starter culture for conjugation, replacing the overnight culture described in the procedure above (see general methods). These can be used to conjugate strains such ISOM-5032, ISOM-5033, ISOM-5034 or ISOM-5035.

Example 4: Generation of Parental Constructs and Strains for Creation of Selection System Isolation of the S. rapamycinus mutant ISOM-5032 carrying the chromosomal deledon of apB Plasmid pAW009 (SEQ ID NO 70) is a pKC1139-based shuttle vector (Bierman et al., 1992), which contains a codA cassette (SEQ ID NO 75), (Dubeau et al., 2009) cloned into Bglll site. Two fragments of the rapB gene are amplified from S. rapamycinrcus NRRL5491 genomic DNA (isolated using MP Biomedicals kit as described in general methods) using oligo AW13_1.F (SEQ ID NO 76) and oligo AW13_1R (SEQ ID NO 77) and AW13_2.R with AW AW13_2.R (AW13_2.FOR, SEQ ID NO 78) and (AW13_2.REV, SEQ ID NO 79) and ligated into plasmid pAW009, resulting in plasmid pAWD13. This plasmid was confirmed by restriction enzyme digestion and sequencing, and conjugated into *S. rapamycinicus* NRRL5491. The integration of the plasmid into the rapB gene was confirmed by PCR, and the loss of production phenotype was confirmed by performing fermentation and comparing to S. rapemycinlcus NRRL5491. The confirmed intermediate strain was then patched on MAM with 5-fluorocytosine and the strain allowed to sporulate. Double crossovers are selected for by assessing loss of apramycin resistance, and confirming the final strain was missing the rapB gene by PCR of genomic DNA and loss of rapamycin production. One strain was selected for further development and called S. rapamycin/cus ISOM-5032.

Plasmid Generation

Plasmid pSMC6 (SEQ ID NO 80) was generated by ligation of an ermE* promoter fragment between the Spel and Ndel sites of plasmid pGP9 (Andexer et al, 2013). Plasmid pSMC8Mut1 was generated by introducing Kpn restriction site between residues 1330 and 1331 by a pair of mutagenic primers Mut1.FOR (SEQ ID NO 42) and Mut1.Rev (SEQ ID NO 43) through a PCR reaction with Pfu ultra polymerase. Afterwards the parent DNA was digested with Dpnl enzyme. Plasmid pSMC6Mut2 was generated by introducing Noil restriction site between residues 2258 and 2259 by a pair of mutagenic primers Mut2.FOR (SEQ ID NO 44) and Mut2.REV (SEQ ID NO 45) through a PCR reaction with Pfu ultra polymerase. Afterwards, the parent DNA was digested with Dpnl enzyme. Plasmid pAW025 was generated by introducing NstI restriction site between residues 5250 and 5251 by a pair of mutagenic primers Mut3.FOR (SEQ ID NO 48) and Mut2.REV (SEQ ID NO 47) through a PCR reaction with Pfu ultra polymerase. Afterwards the parent DNA was digested with Dpn enzyme. Plasmid pAW025 was confirmed by restriction digestion and sequencing.

To obtain plasmid pAW023, pAW025 was digested with Kpnl and Nofi, and the erythromycin and ampicillin resistance cassettes were introduced following amplification using PCR using two pairs of primers EryRes.REV (SEQ ID NO 48) and EryRes.FOR (SEQ ID NO 49) and AmpRes.REV (SEQ ID NO 50) and AmpRes.FOR (SEQ ID NO 51) from plasmid pBF24 (Fayed et al., 2015) using the InFusion cloning method. Then, the resultant plasmid was digested with Sphl and Nsil and the SV1 integrase cassette was introduced following amplification using PCR using primer pair SV1.rev (SEQ ID NO 52) and SV1.for (SEQ ID NO 53) against a template of pBF22 (Fayed st al., 2015) The plasmid was confirmed by restriction digestion and sequencing.

To obtain plasmid pAW033, plasmid pAVV25 was digested with Kpnl and Noi, and the hygromycin resistance cassette introduced following amplification using PCR using a pair of primers HygRes.REV (SEQ ID NO 54) and HygRes.FOR (SEQ ID NO 55) on template plasmid pBF30 (SEQ ID NO 56) using InFusion cloning method. The plasmid was confirmed by sequencing.

To obtain plasmid pAWD50, pAW025 was digested with Kpnl and Noi, and the spectinomycin resistance cassette was introduced following amplification using PCR with a pair of primers SpcRes.REV (SEQ ID NO 57) and SpcRes.FOR (SEQ ID NO 58) from plasmid pAVB-G9m-2 (SEQ ID NO 59) using InFusion cloning method. Then, the resultant plasmid was digested with Sphi and Nsil and the TG1 integrase cassette was introduced following amplification using PCR using primer pair TG1.rev (SEQ ID NO 80) and TG1.for (SEQ ID NO 61) on pBF20 as a template (Fayed et al., 2015). The plasmid was confirmed by cut and sequencing.

To obtain plasmid pAW022, pAV25 was digested with Kpnl and Noti, and the kanamycin and ampicillin resistance cassettes were introduced following amplification using PCR using two pairs of primers KanRes.REV (SEQ ID NO 83) and KanRes.FOR (SEQ ID NO 84) from plasmid pBF22 (Fayed et al., 2015) and AmpRes.REV (SEQ ID NO 50) and AmpRes.FOR (SEQ ID NO 51) from plasmid pBF24 (Fayed et al., 2015) using the InFusion cloning method. Then, the resultant plasmid was digested with Sphl and Nil and the SV1 integrase cassette was introduced following amplification using PCR using primer pair C31.rev (SEQ ID NO 81) and C31.for (SEQ ID NO 82) against a template of pBF30 (SEQ ID NO 58). The plasmid was confirmed by restriction digestion and sequencing.

To obtain plasmid pAW031, pAW025 was digested with Kpnl and Noin, and the kanamycin and ampicillin casettes were introduced following amplification using PCR using two pairs of primers KanRes.Rev (SEQ IS 83) and KanRes.FOR (SEQ ID NO 84) from plasmid pBF22 (Fayed et al., 2015) and AmpRes.REV (SEQ ID NO 50) and AmpRes.FOR (SEQ ID NO 51) from plasmid pBF24 (Fayed et al. 2015) Using the InFusion cloning method. The plasmid was confirmed by restriction digestion and sequencing.

Example 5A: Generation of Constructs for Selection of Cells Producing Compounds Interacting with Both mTOR and FKBP12 (FKBP1a)

Plasmid pAW203

Intermediate plasmid pAW1-G9m-2 was constructed as a synthetic DNA cassette containing sequence (SEQ ID NO 62) consisting of the ermE* promoter sequence followed by codon-optimised α-NTD fragment fused with codon-optimised fragment of FKBP1a in the plasmid pG9m-2 (Gen9bio) inserted between Aarl (1981) and Aarl (2067) sites. This plasmid is used as a template to amplify the 453 bp codon-optimised fragment of FKBP1a using the primer pair AW203A.FOR (SEQ ID NO 89) and AW203A.REV (SEQ ID NO 90). The primer pair AW203B.FOR (SEQ ID NO 91) and AW203B.REV (SEQ ID NO 92) is used to amplify a 1043 bp fragment containing M271_21340 cds (encoding native Streptomyces α-NTD) from Streptomyces rapamycincus NRRL 5491 genomic DNA isolated using MP Biomedicals FastDNA$^T$m SPIN Kit for Soil as per manufacturer's instructions. Both fragments are cloned into pAW031 digested with Ndel and Xbal (NEB) by InFusion cloning (Clontech); briefly, the PCR products undergo 1% agarose gel electrophoresis in 0.5x TBE system, and the product is identified on the gel and isolated using Macherey-Nagel gel extraction kit and eluted in 30 uL water. Two inserts and the backbone are mixed with 2 uL InFusion premix, and the water up to 10 uL The sample is incubated for 15 minutes at 50° C., and 1 uL of the product is used to transform 50 uL E. coli HST08 by heat shock. Finally, the transformants are plated on 2TY with 100 pg/mL ampicillin. The plasmid is confirmed by restriction digestion and Sanger sequencing.

Plasmid pAW048

Intermediate plasmid pAW2-G9m-2 was constructed as a synthetic DNA cassette containing sequence (SEQ ID NO 63) consisting of the ermE* promoter followed by codon-optimised Cl-lambda fused with codon-optimised fragment of FRB (mTOR) ligated into pG9m-2 (Gen9bio) between Aarl (1961) and Aarl (2067) sites by the synthathic DNA provider. This plasmid was digested with restriction enzymes Ndel and Xbal in the presence of CutSmart buffer at 37° C. to generate a 1.08kb fragment. The fragment underwent 1% agarose gel electrophoresis in 0.5x TBE system and was isolated from the gel using Macherey-Nagel gel extraction kit and eluted in 30 uL water. The isolated band ligated with the DNA from the plasmid pAW022 following digestion with Ndel and Xbal and dephosphorylation with Shrimp Alkaline Phosphatase (NEB) following the manufacturers instruction. This mixture was then transformed using electroporation into E. coli DH10B and the resulting plasmid, pAW048 was isolated and confirmed by restriction digestion.

pAW206—Reporter Plasmid

The synthetic DNA fragment AW152 (SEQ ID NO 93) was ordered from IT DNA, which contains the cl-lambda DNA binding domain, a lacZ promoter where the −10 region was altered from tatgttg to cactgc such that it is recognised by Streptomyces α-NTD and an RBS sequence from the Streptomyces coelicolorAfsR gene.

The synthetic DNA was digested with Spel and Ndel, and the resultant fragment was cloned in front of reporter gene as described below: Intermediate plasmid pAW3-G9m-2 was constructed as a synthetic DNA cassette containing sequence SEQ ID NO 64 encoding the fragment containing codon optimised pink protein gene sequence from Stylophora pisa/ata in pG9m-2 plasmid (Gen9Bio) between Aarl (1981) and Aarl (2087) sites.

The AW152 casette is ligated between the Spel and Ndel sites of pAW3-G9m-2 to generate an intermediate plasmid pAW204. Then the plasmid Is digested with Ndei and Xbal, and the apramycin resistance gene cloned from pSMC8 (SEQ ID NO 80) using primer pair AW205.FOR (SEQ ID NO 94) and AW205.REV (SEQ ID NO 95) to generate intermediate plasmid pAW205.

The primer pair AW206A.FOR (SEQ ID NO 65) and AW206A.REV (SEQ ID NO 66) is used to amplify the 931 bp fragment of pAW204 using CloneAmp™ HiFi PCR Premix in the presence of 10% DMSO, it undergoes 1% agarose gel electrophoresis and isolation from the gel using NuceoSpin® Gel and PCR Clean-up kit and is eluted with 30 uL.

The primer pair AW206B.FOR (SEQ ID NO 87) and AW208B (SEQ ID NO 88) is used to amplify a 1047 bp fragment from pAW205 using CloneAmp™ HiFi PCR Premix in the presence of 10% DMSO, it undergoes 1% agarose gel electrophoresis and isolation from the gel using NuceoSpin@ Gel and PCR Clean-up kit and is eluted with 30 uL These two fragments are introduced Into vector pAVW23 following digestion with Spel and Xbel according to the InFusion method (Clontech) to generate the plasmid pAW208. This mixture is then transformed using heat shock into Stellar cells HST08 and selected using appropriate antibiotic (erythromycin 50 pg/mL) as a selection marker and the resulting plasmid, pAW208 is isolated and confirmed by restriction digestion.

Generaton of S.Rapamycinicus ISOM-5033, the Selection Strain

Plasmids pAW203, pAVW48 and pAW208 are subsequently transferred to Streptomyces rapamycintcus rapB knock-out strain ISOM-5032 by conjugation using standard methods (see general methods). The exconjugants are confirmed by multiplex PCR to contain all the genes of interest and the strain is named S.rapamycincus ISOM-5033.

Selection of Cells Producing Compounds Interacting with Both mTOR and FKBP12 Using Antibiotic Selection Spores of S.repamycinicus ISOM-5033 are subsequently conjugated with a mixture of plasmids expressing a library of RapB variants, such as that described in examples 1, 2, 3, 10 and 11 and grown in RapV7 seed medium without the antibiotic selection (7 mL) in a Falcon tube (50 mL) plugged with a foam bung and cultured at 28° C. and 300 rpm (2.5 cm throw) for 48 h. MD6 production media (7 mL) is inoculated with this seed culture (0.35 mL) using a wide-orifice tip and fermented for 3 days at 26° C. and 300 rpm (2.5 cm throw). Then the medium is diluted as a series and plated onto MD6 plates containing varying levels of apramycin. To reduce the need for assessing false positives, assessment of production of pink pigment is used.

Example 5B: Generation of Constructs for Selection of Cells Producing Compounds Interacting with Both mTOR and FKBP12 (FKBP1a) (Second Method)

Intermediate plasmid pAW1-G9m-2 was ordered from gen9bio as a a synthetic DNA cassette containing sequence (SEQ ID NO 62) consisting of the emE* promoter sequence followed by codon-optimised α-NTD fragment fused with codon-optimised fragment of. FKBP1a in the plasmid pG9m-2 (Gen9bio) inserted between AMd (1961) and Aarl (2067) sites by the synthetic DNA provider.

Intermediate plasmid pAW2-G9m-2 was ordered from gen9bio as a synthetic DNA cassette containing sequence (SEQ ID NO 63) consisting of the ermE promoter followed by codon-optimised Cl-lambda fused with codon-optimised fragment of FRB (mTOR) ligated into pG9m-2 (Gen9bio) between Aarl (1961) and AMl (2067) sites by the synthetic DNA provider.

An intermediate plasmid pJP004 was generated as follows: plasmid pSMC6 (SEQ ID NO 80) was digested with NdeI and XbaI in the presence of the CutSmart buffer at 37 deg C. to form the vector backbone; 1124 bp band from pAW1-G9m-2 was amplified using pFused2_1.FOR ggtag-gatccacataATGCAGGGTTCT (SEQ ID NO 173) and pFused2_2.FOR CACAGGATACTCGAGGATCCCC (SEQ ID NO 174) using CloneAmp™ HIFI PCR Premix, 294 bp band from pAW2-G9m-2 amplified using CTCGAGTATCCTGTGGCACGAGA (SEQ ID NO 175) and CloneAmpr™ HiFi PCR Premix and GTGCT-CATCTTGGAGATGCGGC (SEQ ID NO 176), 733 bp band from pAW2-G9rn-2 amplified using CTCCAAGAT-GAGCACAAAAAAGAAACC (SEQ ID NO 177) and tgagatctggtctagGCCAAACGTCTCTTCA (SEQ ID NO 178) and CloneAmp™ HIFi PCR Premix. All the products underwent gel electrophoresis on 1% agarose gel in 0.5x TBE system, and the correct bands were identified on the gel, excised and extracted using Macherey-Nagel gel extraction kit and eluted in 30 uL water. The bands were mixed and 2 uL InFusion premix was added, and the sample was incubated at 50° C. for 15 minutes. 1 uL of the product was used to transform E. coli HST08 by heat shock, and the transformants were plated on 2TY with 50 pg/mL apramycin for selection. The correct clones were confirmed by double digest and Sanger sequencing.

An intermediate plasmid pAW180 was generated as follows: a 1418 bp fragment was amplified using a primer pair gcagtacATGGGCGTCCAGG (SEQ ID NO 179) and tgagatctggtctagatcagctaattaagcttagtgat (SEQ ID NO 180) from pJP004, and a 1045 bp fragment containing *Streptomyces* DNA-directed RNA polymerase subunit a of *Streptomyces rapamycinicus* NRRL 5491 was amplified from genomic DNA of ISOM-3410 isolated as described in general methods using a primer pair ACGCCCATg-toctgctcggtctcc (SEQ ID NO 181) and ggtaggatccacatat-gatgctgatcgctcag (SEQ ID NO 182), and both fragments were cloned into plasmid pAW031 digested with NdeI and XbaI by InFusion cloning: briefly the PCR products underwent 1% agarose gel electrophoresis in 0.5x TBE buffer, and the bands of interest were identified on the basis of masses indicated above. The bands were isolated from the gel using Macherey-Nagel gel extraction kit and eluted in 30 uL water each. 1 uL of each band was mixed with 0.5 uL isolated vector, 2 uL of InFusion premix, and water to 10 uL, and the sample was incubated for 15 minutes at 50° C. 1 uL of the product was used to transformed 50 uL of E. coli HST08 cells by heat shock, and the transformants were plated on 2TY with 100 pg/mL ampicillin for selection. The correct clones were identified by restriction digest and Sanger sequencing.

To generate plasmid pAW304, the 1877 bp fragment was amplified using primer pair AW332 (agt-taggctaactagttttttggccttgaaetcgt (SEQ ID NO 183)) and AW333 (atgactagaccgagcgcagcg (SEQ ID NO 184)) from plasmid pAW180 using CloneAmp$^T$M HiFi PCR Premix in the presence of 10% DMSO, it underwent 1% agarose gel electrophoresis and isolation from the gel using Nucleo-Spin@ Gel and PCR Clean-up kit and eluted with 30 uL A1274 bp fragment from plasmid pAW048 was amplified using CloneAmp$^T$m HiFi PCR Premix in the presence of 10% DMSO (amplified with primer pair AW334 (gctcggtctagtcatgcgagtgtc (SEQ ID NO 185)) and AW335 (tgagatctggtctagACAGATCCGGCG (SEQ ID NO 188)), it underwent 1% agarose gel electrophoresis and isolation from the gel using NuceoSpin® Gel and PCR Clean-up kit and eluted with 30 uLpAW031 backbone was digested using SpeI and XbaI in CutSmart buffer (NEB), it underwent 1% agarose gel electrophoresis and isolation from the gel using NucleoSpin@ Gel and PCR Clean-up kit and eluted with 30 uL iuL of each insert and 0.5 uL vector were combined with 2 uL InFusion premix (Clonetech) and water up to ~10 uL, and the sample was incubated at 50° C. for 15 minutesThe 1 uL of the product was used to transform E. coli HST08 cells, and the correct clones were identified by restriction digest and Sanger sequencing.

A DNA fragment of plasmid pBF20 (Fayed et al., 2015) containing the expression cassette for TG1integrase and attP site was amplified by PCR using the primer pair TGI.FOR (ccgtcgacctgcaggcatgccgctaggaacagttgc (SEQ ID NO 197) and TGI.REV gaaccgtccgccggatgcatgtaagcgtcacggca (SEQ ID NO 198)) and inserted by InFusion cloning into piasmid pAW025 digested with SphI and NsiI to generate an intermediate plasmid pAW038. A DNA fragment of plasmid pBF30 containing the hygromycin resistance cassette was amplified using the primer pair (tgtgcagctccatcggtac-cactcttccttttcaatgg (SEQ ID NO 187) and gccccagcagcggccgcagttgcctgactcccc (SEQ ID NO 188)) and ligated into pAW038 digested with KpnI and NotI to generate plasmid pAW024. Plasmid pAW024 was digested with SpeI and XbaI and a the DNA fragment amplified from pAW044 amplified using primer pair agttaggctaactagtctagt-caacacgcacggtgttaag (SEQ ID NO 189) and tgagatctggtctagaatcagccaatcgactggcg (SEQ ID NO 190) was inserted to generate the intermediate plasmid pAW070.

The synthetic DNA fragment AW152 (SEQ ID NO 93) was ordered from IT DNA, which contains the cl-lambda DNA binding domain, a IacZ promoter where the −10 region was altered from tatgttg to cactgc such that it is recognised by *Streptomyces* α-NTD and an RBS sequence from the *Streptomyces* coelicolor.AfsR gene. This fragment was ligated into pUC19 between the NdeI and XbaI sites for maintenance, to generate an intermediate plasmid pAW152. The fragment between the restriction sites SpeI and NdeI was then excised and ligated into the intermediate plasmid pAW070 to generate an intermediate plasmid pAW170. Finally, the fragment between sites NdeI and XbaI was introduced into pAW300. Plasmid pAW300 was generated as follows: a 1284 bp DNA fragment was amplified using the primer pair (tgagatctggtctagaggatccccggg (SEQ iD NO 191) and gaggagcgaagcataatgagattcaacttattgggac (SEQ ID NO 192)) from plasmid pCJR24 (Rowe et al *Gene*, 218, 215-223) and inserted into pAW159 between the NdeI and XbaI sites by InFusion cloning. The resultant plasmid was used to generate a reporter plasmid where the 810 bp fragment of plasmid pAW180 was excised with NdeI and XbaI, it underwent 1% agarose gel electrophoresis in 0.5x TBE system, and was isolated from the gel using Macherey-Nagel gei extraction kit and eluted in 30 uL water and the isolated fragment was introduced by ligation with $T_4$ ligase (NEB) between the NdI and XbaI sites of plasmid pAW300 (processed in the same way) to generate the reporter plasmid pAW302. The resultant plasmid was confirmed by restriction digest Intermediate plasmid pAW031 was digested with SpeI and XbaI and the DNA fragment amplified from plasmid pAW180 using primer pair agttaggctaactagttttttggcctt-gaaatcgt (SEQ ID NO 193) and atgactagaccgagcgcagcg (SEQ ID NO 194) and a fragment amplified from plasmid pAW048 amplified using primer pair (gctcggtctagt-catgcgagtgtc (SEQ ID NO 195) and tgagatctggtctagACA-GATCCGGCG (SEQ ID NO 198)) were cloned using InFusion cloning.

Plasmids pAW304 and pAW302 are transferred to *Streptomyces* rapamycmnicus ISOM-5032 (rapB knockout) by conjugation using standard methods (see general methods). Spores of to generate *S.rapamycinicus* ISOM-5911 are subsequently conjugated with a library of rapB variants generated as described in example 1, 2, 3, 12 and 13 in RapV7 seed medium without the antibiotic selection (7 mL of RapV7) in a Falcon tube (50 mL) plugged with a foam bung and cultured at 28° C. and 300 rpm (2.5 cm throw) for 48 h. MD6 production media (7 mL) is Inoculated with this seed culture (0.35 mL) using a wide-orifice tip and fermented for 3 days at 26° C. and 300 rpm (2.5 cm throw). Then the medium is diluted as a series and plated onto MD6 plates containing varying levels of apramycin (50-150 pg/mL). The surviving strains produce novel rapamycin analogues with qualities of interest.

Example 6: Selection of Cells Producing Compounds Interacting with Both mTOR and FKBP Using a Cell Sorter Spores of *S.rapamycinicus* ISOM-5033 are conjugated with a mixture of plasmids expressing a library of RapB variants, such as that described in examples 1, 2, 3, 12 and 13 and grown in RapV7 seed medium without the antibiotic selection (7 mL) in a Falcon tube (50 mL) plugged with a foam bung and cultured at 28° C. and 300 rpm (2.5 cm throw) for 48 h. MD6 production media (7 mL) is inoculated with this seed culture (0.35 mL) using a wide-orifice tip and fermented for 3 days at 26° C. and 300 rpm (2.5 cm throw). The 5 mL samples from each culture are transferred to 15 mL Falcon tubes and washed with Phosphate Buffered Saline (PBS). The cells are then loaded onto the cell sorter (Blo-Rad), and the sorting procedure is performed as known to person skilled in the art.

Example 7A: Generation of Constructs Able to Select Variants of Novel Compound Able to Interact with Calcineurin and FKBP12

Plasmid pAW049

Plasmid pAW4-G9m-2 was constructed as a synthetic DNA cassette SEQ ID NO 69 containing the ermE* promoter sequence followed by codon-optimised Cl-lambda sequence and a Leu-Glu linker CTCGAG fused with codon-optimised fragment of active calcineurin phosphatase domain composed of fragment of can followed by a Leu-Glu linker GTCGAG and a fragment of calcineurin B (CnB) (Clemons et al., 2002). The cassette is expressed as a single polypeptide chain in the target strain.

This plasmid was digested with restriction enzymes NdeI and XboI to generate an 2.415kb fragment. The fragment was ligated with the DNA from vector pAW050 following digestion with NdeI and XbaI and dephosphorylation with Shrimp Alkaline Phosphatase (NEB) following the manufacturer's instructions. This mixture then transformed using electroporation Into *E. coli* DH10B and the resulting plasmid, pAW049 is isolated and confirmed by restriction digestion.

Plasmids pAW203, pAWD49 and pAW206 are subsequently transferred to *Streptomyces* rapamycircus rapB knock-out strain ISOM-5032 by conjugation using standard methods (see general methods).

The exconjugants are confirmed by multiplex PCR to contain all the genes of interest and the strain is named *S.rapamycinicus* ISOM-5034.

Example 7B: Generation of Constructs Able to Select Variants of Novel Compound Able to Interact with Calcineurin and FKBP12 (Second Method)

A 2667 bp fragment was amplified from pAWD49 using primer pair AW372 ggtaggatccacaTATGtatgAGCACAAA (SEQ ID NO 199) and AW373 gACA-GATCCGGCGCGCGCagagcgcccaatacg (SEQ ID NO 200) and cloned into pAW304 digested with NdeI and AscI to generate the plasmid pAW317. Briefly the primer pair mentioned above was used to amplify a 2667 bp product using template of plasmid pAW049 and CloneAmpm HIFI PCR Premix in the presence of 10% DMSO. The product underwent gel electrophoresis using 1% agarose gel in the 0.5x TBE system. The band of Interest was identified on the gel, and excised and isolated using Macherey-Nagel Nucleo-Spin@ Gel and PCR Clean-up. The plasmid backbone was prepared on the basis of pAW304 which was digested with NdeI and AscI in the presence of CutSmart@ Buffer at 37° C. The product of digestion underwent gel electrophoresis using 1% agarose gel in the 0.5x TBE system. The 8309 bp backbone was identified on the gel, and excised and isolated using Macherey-Nagel NucleoSpin@ Gel and PCR Clean-up. 1 uL of the insert and 0.5 uL of the vector were mixed with 2 uL InFusion premix and 8.5 uL water, and the sample was Incubated at 50° C. for 15 minutes. 1 uL of the product was used to transform *E. coli* HST08 cells using a heat shock method, and the transformants were plated on 2TY with 100 pg/mL ampicillin for selection. The correct clones were confirmed using double digest, and Sanger sequencing.

Example 9: Obtaining Novel Biologically Active Rapamycin-Based Natural Products Targeted Towards Calcineurin and FKBP12

Spores of *S.rapamycinicus* ISOM-5034 are conjugated with a mixture of plasmids expressing a library of RapB variants, such as that described in examples 1, 2, 3, 12 and 13 and grown in RapV7 seed medium without the antibiotic selection (7 mL) in a Falcon tube (50 mL) plugged with a foam bung and cultured at 28° C. and 300 rpm (2.5 cm throw) for 48 h. MD6 production media (7 mL) is inoculated with this seed culture (0.35 mL) using a wide-orifice tip and fermented for 3 days at 26° C. and 300 rpm (2.5 cm throw). The 5 mL samples from each culture are transferred to 15 mL Falcon tubes and washed with PBS. The cells are then loaded onto the cell sorter (Bio-Rad), and the sorting procedure is performed as known to person skilled in the art.

Example 10: Obtaining Novel Biologically Active Rapamycin-Based Natural Products Targeted Towards Fungal, but not Mammalian Calcineurin Plasmid pAW7-G9m-2 Is constructed as a synthetic DNA cassette SEQ ID NO 71 containing the ermE* promoter sequence followed by AdpA-DBD domain from *Streptomyces giseus* and a Leu-Glu linker CTCGAG fused with codon-optimised fragment of active fungal calcineurin phosphatase domain composed of fragment of can followed by a Leu-Glu linker GTCGAG and fragment of mammalian calcineurin B. The cassette is expressed as a single polypeptide chain in the target strain.

This plasmid is digested with restriction enzymes NdeI and XboI to generate an 2.415kb fragment the fragment is ligated with the DNA from plasmid pAW025 following digestion with NdeI and XbaI and dephosphorylation with Shrimp Alkaline Phosphatase (NEB) following the manufacturer's instructions. This mixture then transformed using electroporation into *E. coli* DH10B and the resulting plasmid, pAWD53 Is isolated and confirmed by restriction digestion. Plasmid pAW057 is created from plasmid pAW206, where the pink protein is replaced with the codon optimised eGFP sequence (Sun et al., 1999). Plasmid pAW055 Is created from plasmid pAW206, where the pink protein is replaced with the codon optimised mCherry sequence (Shaner et al., 2004) and the cl lambda recognition sequence is replaced with sequence AdpA-DBD recognition sequence SEQ ID NO 72.s S. rapemycinicus ISOM-5032 is conjugated with pAW203, pAW053, pAW057 and pAW055, resulting in strain ISOM-5035. Spores of ISOM-5035 are conjugated with a library generated as described above grown on the production medium (MD6). The production medium pellet is then a subject of fluorescent activated cell sorting (FACS), for example using a BIO-RAD cell sorter. The cells expressing the green fluorescent protein, but not red fluorescent protein, are selected as cells of interest

Example 11: Obtaining Novel Biologically Active Rapamycin-Based Products Targeted Towards Yeast, but not Mammalian Calcineurin A 25 bp recognition DNA sequence is designed as a 50% GC-rich sequence using an online tool (for example faculty.ucr.edu/~mmaduro/random.htm), and is named SEQ ID NO 73. A TAL-effector domain is designed using SEQ ID NO 73 as described before (Sanjana et al, Nature Protocols 2011). The TAL-effector domain is fused with the mammalian calcineurin domain described in patent example 7 and the whole cassette is ordered from gen9. SEQ ID 74, 25 bp recognition DNA sequence different to SEQ ID NO 73 is designed as above, and used to design another TAL-effector domain, that is fused with fungal calcineurin domain described in patent example 10 Both cassettes are expressed under strong constitutive promoters, ermE*. The reporter strain includes the 25 bp recognition DNA sequence SEQ ID NO 73 followed by −35 and −10 bp fragments, designed as described before. The domain is followed by codon-optimised eGFP and a transcription terminator. On the seme plasmid, SEQ ID NO 74 sequence is followed by −35 and −10 bp fragments, designed as described before, and by codon-optimised mCherry and a transcription terminator.

Spores of *S.rapamycinicus* ISOM-5032 are conjugated with above plasmids and a mixture of plasmids expressing a library of RapB variants, such as that described in examples 1, 2, 3, 12 and 13 and grown in RapV7 seed medium without the antibiotic selection (7 mL) in a Falcon tube (50 mL) plugged with a foam bung and cultured at 28° C. and 300 rpm (2.5 cm throw) for 48 h. MD8 production media (7 mL) is inoculated with this seed culture (0.35 mL) using a wide-orifice tip and fermented for 3 days at 26C and 300 rpm (2.5 cm throw). The 5 mL samples from each culture are transferred to 15 mL Falcon tubes and washed with Phosphate Buffered Saline (PBS). The cells are then loaded onto the cell sorter (Blo-Rad), and the sorting procedure is performed as known to person skilled in the art. The strains that do not show fluorescence of eGFP, but show fluorescence of mCherry, are kept as strains of interest.

Figure 8A:
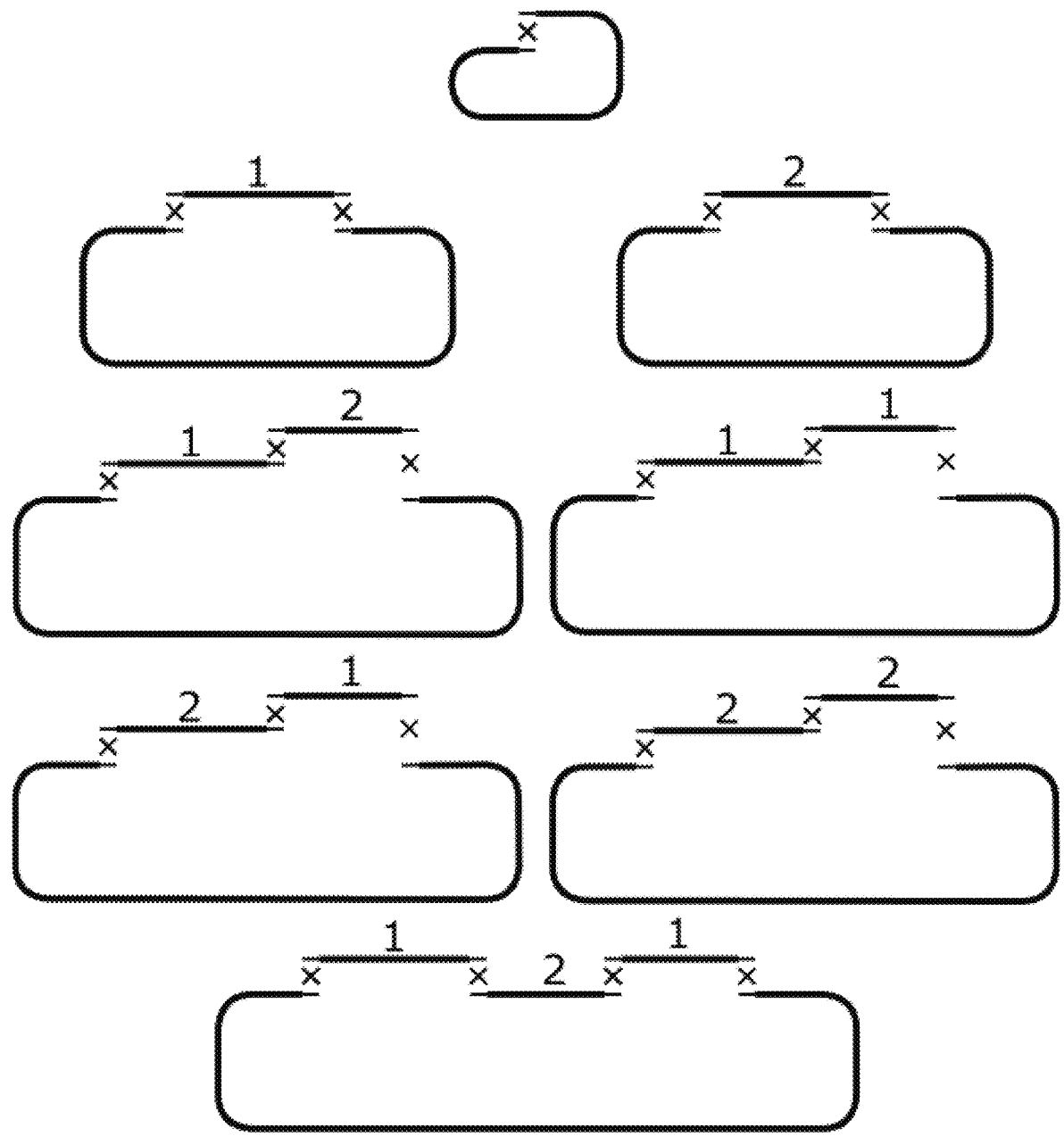
FIGS. 8A and 8B.
Figure 8B:
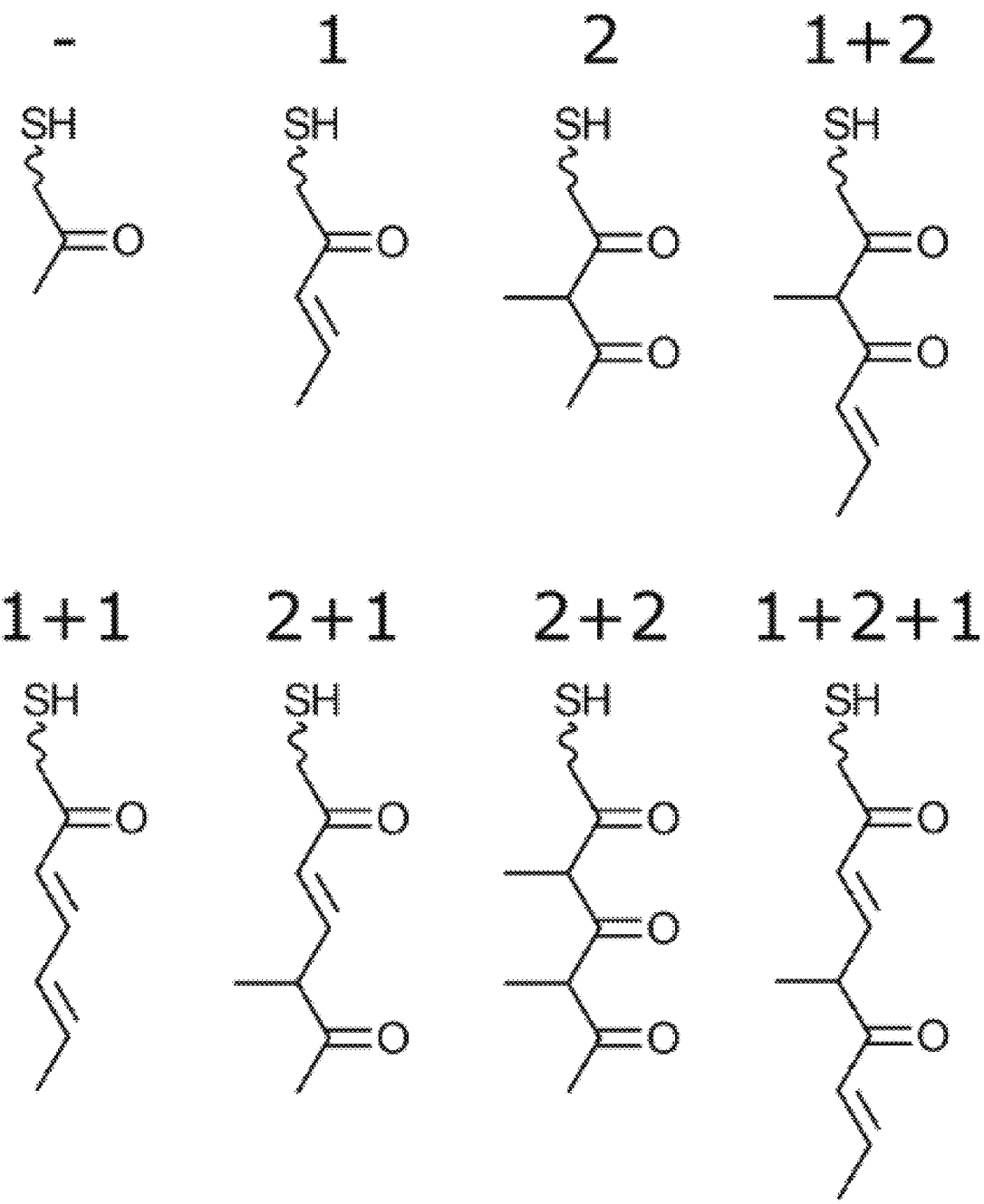

Example 12: Generation of a Generic Rapamycin-Based Diversity Library Using Type IIS Restriction Enzyme Cloned Junctions A library with a broad range of diversity can be generated using the procedure outlined in example 1 by using multiple different inserts in the final assembly step. By following the procedure outilned in the section for the generic junction design and the example therein, and ensuring the 3' overhanging sequence left by digestion with BaeI is Identical for all Inserts, ligation of all the inserts and plasmids in a single reaction results in a library of PKS-encoding genes that contains module inserts in random order and in a range of numbers (FIG. 8A), resulting in a wide variety of polyketide chain extensions (FIG. 8B). Examples of combinations that can be obtained by introduction of two different module inserts include, but are not limited to, no insert, only Insert 1, only insert 2, insert 1 followed by insert 2, Insert 1 followed by Insert 1, insert 2 followed by insert 1, insert 2 followed by insert 2 and insert 1 followed by insert 2 followed by insert 1. More combinations can occur using this method and more and other Inserts could be included in the assembly reaction.

Inserts that could be used to expand diversity of the library Include, but are not limited to, modules that different extender units to the polyketide chain, including but not limited to, malonyl-CoA, methylmalonyl-CoA or ethylmalonyl-CoA, perform different levels of reductive chemistry, Including but not limited to, reduction of the keto group to a hydroxy group, reduction of the keto group to an enoyl bond or complete reduction of the keto group, perform different levels of reductive chemistry-with different modifications to stereochemistry, either at the α-carbon or the β-carbon position, or any combination of the above and other options not mentioned. Examples of modules with different combinations of extender selectivity and level of reduction chemistry that could be used as inserts in this system, are shown in the table below. The list shown in the table is not exhaustive, other modules that perform the same chemistry as the modules shown but are derived from different biosynthesis clusters can be used in this system, as well as modules that perform other reactions or utilise different extender units not mentioned here.

| | Reducing domains | | | |
|---|---|---|---|---|
| Extender | — | KR | KR + DH | KR + DH + ER |
| Malonate | Rapamycin module 14 | Rapamycin module 2 | Rapamycin module 8 | Oligomycin module 3 |
| Methyl malonate | Rapamycin module 6 | Oligomycin module 2 | Rapamycin module 10 | Rapamycin module 7 |
| Ethyl malonate | | Concanamycin module 10 | Salinomycin module 1 | Oligomycin module 7 |

Example 13: Generation of a Generic Diversity Library Using *Saccharomyces Cerevisiae* in Vivo Homologous Recombination of Cloned Non-Native Junctions In this experiment, information about Junction region 1 as described in this document are used to design non-native junction regions that promote Saccheromyces cerevdsIae-mediated recombination between numerous module-encoding fragments allowing generation of larger rational PKS libraries.

Figure 7A:
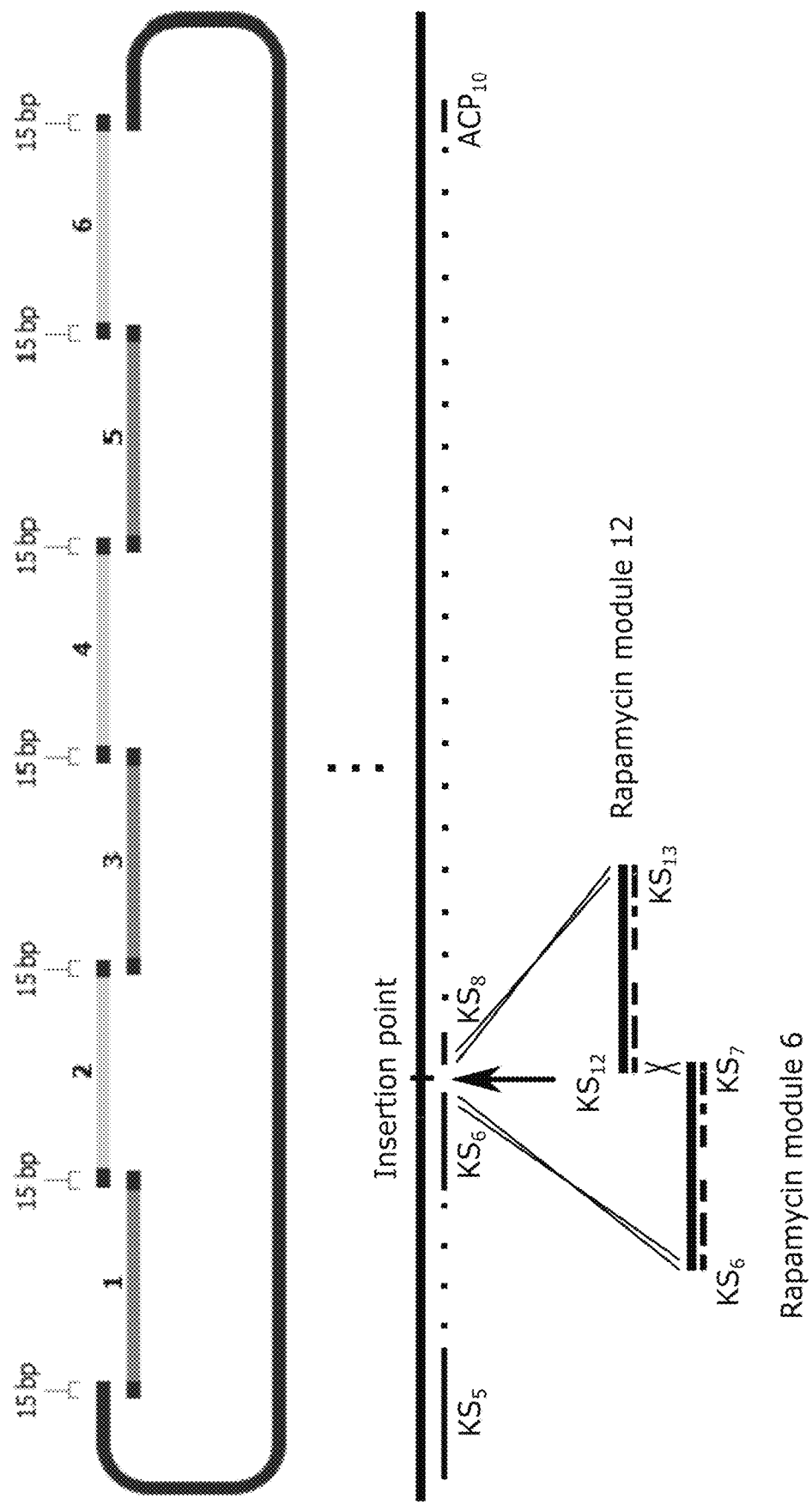

First, the PKS gene for which the library is desired is selected. A plasmid, analogous to pDiv001-6 in example 3, is constructed that contains some portion of the PKS gene that is to remain invariant (for example the first and last module) and an insertion point for assembly of multiple modules in several positions. The Insertion point contains a LHS and RHS junction region. This is described in example 3 and FIG. 7A with Rapamycin modules 6 and 12 being inserted in to a partial rapB (module 5, module 6 up to KS6, KS8 of module 8 and onwards) to generate a synthetic PKS gene that encodes modules 5, 8, 12, 8, 9 and 10 based on KS Junction region 1. The specific order of assembly is achieved using module-encoding fragments that contain overlapping junction regions comprised of non-native sequence as described in yeast recombination generic design 2 in the section generic junction design. A fragment corresponding to the first module to be inserted (module a) starts with sequence corresponding to its KS ($KS_a$) and ends with sequence corresponding to the KS of the next module in the gene ($KS_{a+1}$). Example 3 and FIG. 7A illustrate this for Rapamycin modules 6 and 12. The sequence of module a starts at a chosen position within LHS junction region 1 ($KS_a$) and overlaps with the LHS Junction region 1 ($KS_a$) of the insertion point. The extent of overlap is up to and including the entire Junction region 1 (see FIG. 2). The sequence of module b (the second module to be inserted) starts at a chosen position within Junction region 1 ($KS_b$-the KS belonging to this second module) and overlaps with the RHS Junction region 1 of module a ($KS_{a+1}$). The extent of overlap is up to and including the entire Junction region 1 (see FIG. 2). Similarly, sequence of module c (the third module to be inserted) starts at a chosen position within Junction region 1 ($KS_c$) and overlaps with the RHS Junction region 1 of module b ($KS_{b+1}$). The extent of overlap is up to and including the entire Junction region 1 (see FIG. 2). Additional modules can be added to the assembly in a similar fashion.

*Saccharomyces cerevisiae* is able to recombine modules a, b, c and more if included using regions of identity present in the junction regions chosen at the ends of the modules. Single base changes (that are silent at the amino acid level) in the overlapping junction regions at the end of module a and the start of module b are introduced in the same positions. Similarly, silent base changes are also introduced in the overlapping junction regions of modules b and c in the same fashion. The changes made are such that regions of unique identity between the overlap regions of modules a and b are created (see KS7 and KS12 in FIG. 7C as an example) and also unique identity between the overlap regions of modules b and c are created (see KS8 and KS13 in FIG. 7C as an example). This ensures ordered assembly of modules such that module a is inserted in position 1, module b in position 2 and module c in position 3. A diverse library can be created based on this principle by including multiple versions of module a, multiple versions of module b, multiple versions of module c and so on with each module a/b/c variant including but not limited to different extender unit function and different combinations of reductive domains as described further in Example 12.

Example 14: Testing and Comparing of KS Junction Sites

The rapamycin PKS consists of 18 modules, encoded by four genes (see FIG. 11). In this experiment, a rapamycin analogue is generated by complementing a rapB gene knockout, which encodes modules 5-10, with synthetic genes lacking modules 5-7. The genes vary in the location of the junction between module 5 and 8, all locations being part of the KS 'hotspot' disclosed in this document Plasmid pRAR108, containing a truncated rapB gene variant, was obtained as follows. A 441 bp DNA fragment was amplified by PCR using plasmid pHSG299 (TaKaRa Bio.) as template with primers SEQ ID 96 and SEQ ID 97. A 207 bp DNA fragment was amplified by PCR using pGP9 (Andexer et al, 2013) as template with primers SEQ ID 98 and SEQ ID 99. The product was digested with restriction enzymes Asel and Xba. A 3170 bp DNA fragment was amplified by PCR using pRR06 as template with primers SEQ ID 100 and SEQ ID 101. These three fragments were assembled into plasmid pRAR095 using the InFusion cloning method.

A 3785 bp DNA fragment was amplified by PCR using plasmid pRAR095 as template with primers SEQ ID 102 and SEQ ID 103. The fragment was cicularised using the InFusion cloning method, resulting in plasmid pRAR095b.

Plasmid pRARO47, containing the synthetic DNA sequence SEQ ID 104 ligated into sites Aarl (1981) and Aarl (2067) of pG9m-2 (Gen9 Blo.) was used as a template in a PCR with primers SEQ ID 105 and SEQ ID 108. A 595 bp DNA fragment was amplified by PCR using plasmid pRAR095b with primers SEQ ID 98 and SEQ ID 107. Both fragments were assembled into plasmid pRAR097 using the InFusion cloning method.

Plasmid pRR0 was linearized by digestion with restriction enzyme Sapl. Plasmid pRR02 was digested with restriction enzyme Sapl, resulting in a 2637 bp fragment Plasmid pRAR033, containing synthetic DNA sequence SEQ ID 130 ligated into sites Aarl (1961) and Aarl (2067) of pG9m-2 (Gen9 Bio.) was digested with restriction enzyme Sapl, resulting in a 3495 bp fragment Plasmid pRAR057, containing synthetic DNA sequence SEQ ID 108 ligated into sites AarI (1961) and AarI (2067) of pG9m-2 (Gen9 Blo.) was digested with restriction enzyme Sapl, resulting in a 3495 bp fragment Plasmid pRR05 was digested with restriction enzyme Sapl, resulting in a 3495 bp fragment Plasmid pRAR095 was digested with restriction enzyme Sapl, resulting in a 1745 bp fragment. The DNA of Sapl-digested pRR0, pRR02, pRARO33, pRAR057, pRR05 and pRAR095 were assembled using the InFusion cloning method, resulting in plasmid pRAR100.

Plasmid pRAR100 was digested with restriction enzyme Bael and circularized by ligation, resulting in plasmid pRAR107.

Plasmid pRR0 was linearized by digestion with restriction enzyme Sapl. Plasmid pRR02 was digested with restriction enzyme Sapl, resulting in a 2637 bp fragment Plasmid pRAR033 was digested with restriction enzyme Sapl, resulting in a 3495 bp fragment Plasmid pRAR057 was digested with restriction enzyme Sapl, resulting in a 3495 bp fragment Plasmid pRR05 was digested with restriction enzyme Sapl, resulting in a 3495 bp fragment Plasmid pRAR097 was digested with restriction enzyme Sapl, resulting in a 1745 bp fragment. The DNA of Sapl-digested pRR0, pRR02, pRAR033, pRAR057, pRR05 and pRAR097 were assembled using the InFusion cloning method, resulting in plasmid pRAR109.

A 2104 bp fragment was amplified by PCR using SEQ ID 56 as template with primers SEQ ID 117 and SEQ ID 118. Plasmid pAW025 was linearized by digestion with restriction enzymes Nsil and Sphl. Both fragments were assembled using the InFusion cloning procedure, resulting in plasmid pAW041.

Plasmid pAWD41 was linearized by digestion with restriction enzymes Nde/and Xbal. Plasmid pRAR107 was digested with NdeI and Xbel, resulting in a 15,021 bp fragment. This fragment was ligated with linearized pAW041, resulting in plasmid pRAR108.

Plasmid pAW041 was linearized by digestion with restriction enzymes Ndei and XbaL. Plasmid pRAR109 was digested with NdeI and Xble, resulting in a 15,662 bp fragment. This fragment was ligated with linearized pAW041, resulting in plasmid pRAR112.

Plasmid pRAR112 was digested with restriction enzyme Bael and circularized by ligation, resulting in plasmid pRAR112b.

Plasmid pRAR097 was digested with restriction enzyme Afill, resulting in a 608 bp fragment pRR06 was digested with restriction enzyme Sapl, resulting in a 1990 bp fragment. Synthatic DNA sequence SEQ ID 110 was used as template in a PCR with primers SEQ ID 111 and SEQ ID 112. These DNA fragments and synthetic DNA sequence SEQ ID 109 were assembled using the InFusion cloning procedure, resulting in plasmid pRAR115.

Plasmid pRR0 was linearized by digestion with restriction enzyme Apal. A 987 bp DNA fragment was amplified by PCR using plasmid pHSG299 (TaKaRa Blo.) as template with primers SEQ ID 113 and SEQ ID 114. The resulting fragment was digested with restriction enzyme Apal and ligated with linearized pRR0, resulting in plasmid pRAR132.

Plasmid pRAR132 was linearized with restriction enzyme Sapl. Plasmid pRR02 was digested with restriction enzyme Sapl, resulting in a 2637 bp fragment Plasmid pRAR033 was digested with restriction enzyme Sapl, resulting in a 3495 bp fragment Plasmid pRAR057 was digested with restriction enzyme Sapl, resulting in a 3495 bp fragment Plasmid pRR05 was digested with restriction enzyme Sapl, resulting in a 3495 bp fragment Plasmid pRAR115 was digested with restriction enzyme Sapl, resulting in a 1318 bp fragment. The DNA of Sapl-digested pRR0, pRR02, pRAR033, pRAR057, pRR05 and pRAR115 were assembled using the InFusion cloning method, resulting in plasmid pRAR116.

Plasmid pAW041 was linearized with restriction enzyme Pcil. A 704 bp DNA fragment was amplified by PCR using plasmid pET29b(+) (Novagen) using primers SEQ ID 115 and SEQ ID 116. Both fragments were assembled using the InFusion cloning method, resulting in plasmid pRAR133.

Plasmid pRAR116 was digested with restriction enzymes NdeI and XbaI, resulting in a 15,295 bp fragment. Plasmid pRAR133 was linearized with restriction enzymes NdeI and XbaI. Linearised pRAR133 and the fragment obtained from pRAR116 were ligated together, resulting in pRAR117L Plasmid pRAR117 is digested with restriction enzyme Sapl, resulting in a 20,761 bp fragment Synthatic sequence SEQ ID 117 is cloned into the pRAR117 fragment using the InFusion cloning procedure, resulting in pRAR118.

Plasmid pRAR117 is digested with restriction enzyme Sapl, resulting in a 20,761 bp fragment Synthatic sequence SEQ ID 118 is cloned into the pRAR117 fragment using the InFusion cloning procedure, resulting in pRAR119.

Plasmid pRAR117 is digested with restriction enzyme Sapl, resulting in a 20,761 bp fragment Synthatic sequence SEQ ID 119 is cloned into the pRAR117 fragment using the InFusion cloning procedure, resulting in pRAR120.

Plasmid pRAR117 is digested with restriction enzyme Sapl, resulting in a 20,761 bp fragment Synthatic sequence SEQ ID 120 is cloned into the pRAR117 fragment using the InFusion cloning procedure, resulting in pRAR121.

Plasmid pRAR117 is digested with restriction enzyme Sapl, resulting in a 20,761 bp fragment Synthatic sequence SEQ ID 121 is cloned into the pRAR117 fragment using the InFusion cloning procedure, resulting in pRAR122.

Plasmid pRAR117 is digested with restriction enzyme Sapl, resulting in a 20,761 bp fragment Synthatic sequence SEQ ID 122 Is cloned into the pRAR117 fragment using the InFusion cloning procedure, resulting in pRAR123.

Plasmid pRAR117 is digested with restriction enzyme Sapl, resulting in a 20,761 bp fragment Synthatic sequence SEQ ID 123 is cloned into the pRAR117 fragment using the InFusion cloning procedure, resulting in pRAR124.

Plasmid pRAR117 is digested with restriction enzyme Sapl, resulting in a 20,761 bp fragment Synthatic sequence SEQ ID 124 is cloned into the pRAR117 fragment using the InFusion cloning procedure, resulting in pRAR125.

Plasmid pRAR117 is digested with restriction enzyme Sapl, resulting in a 20,761 bp fragment Synthatic sequence SEQ ID 125 is cloned into the pRAR117 fragment using the InFusion cloning procedure, resulting in pRAR126.

Plasmid pRAR117 is digested with restriction enzyme Sapl, resulting in a 20,761 bp fragment Synthatic sequence SEQ ID 126 is cloned into the pRAR117 fragment using the InFusion cloning procedure, resulting in pRAR127.

Plasmid pRAR117 is digested with restriction enzyme Sapl, resulting in a 20,761 bp fragment Synthatic sequence SEQ ID 127 Is cloned into the pRAR117 fragment using the InFusion cloning procedure, resulting in pRAR128.

Plasmid pRAR117 is digested with restriction enzyme Sapl, resulting in a 20,761 bp fragment Synthatic sequence SEQ ID 128 is cloned into the pRAR117 fragment using the InFusion cloning procedure, resulting in pRAR129.

Plasmid pRAR117 is digested with restriction enzyme Sapl, resulting in a 20,761 bp fragment Synthatic sequence SEQ ID 129 Is cloned into the pRAR117 fragment using the InFusion cloning procedure, resulting in pRAR130.

Plasmids pRAR108, pRAR112b, pRAR118, pRAR119, pRAR120, pRAR121, pRAR122, pRAR123, pRAR124, pRAR125, pRAR126, pRAR127, pRAR128, pRAR129 and pRAR130 are used to transform conjugation strain ET12567 carrying plasmid pUZ8002. Transformants are then used to conjugate a suitable *S. rapamycnlcus* strain, such as ISOM-5032 following the procedure described above (see general methods). Mutants containing one of the plasmids mentioned here are subjected to analytical fermentation (see general methods) and extracts are analysed for presence of a contracted rapamycin analogue.

Example 15: Generation of a Small Test Rapamycin-Based Library Using *Saccharomyces Cerevisae* in Vivo Homologous Recombination of Cloned Non-Native Junctions In this slight variant to the experiment described in example 3, the junctions described in this document are used to design non-native junction regions that promote specific recombination cross-over between PKS encoding sequence. Again, novel rapamycin analogues are generated by complementing a rapB gene knockout, which encodes modules 5-10, with a synthetic gene generated by combining module-encoding sequences from rapB and rapC. Junctions between pDJ34, rapB and rapC modules were designed using non-native sequence and using the recombination 'hotspots' disclosed in this document. The non-native junction sequences contain introduced base changes that allow recombination between KS6-pDJ34 and KS6-module 6 but limit recombination between KS6-pDJ34 and KS12-module 12 or between KS6-pDJ34 and KS8-pDJ34. Similarly, recombination between KS7-module 6 and KS12-module 12 is allowed as is recombination between KS13-module 12 and KS8-pDJ34. Recombination between KS7-module 6 and KS8-pDJ34 is limited as Is recombination between KS13-module 12 and KS6-module 6. The non-native junctions permit insertion of module 6 and then module 12 (in that order) and Illustrate the utility of engineered non-native junctions in generating larger ordered rational PKS libraries (see example 13 for a broader description). Plasmid pDJ32, containing part of rapB that allows insertion of module-encoding non-native sequences, was obtained as follows: plasmid pRAR030, containing the synthetic DNA sequence SEQ ID 1 ligated into sites Aarl (1981) and Aarl (2087) of pG9m-2 (Gen9 Bio.) was linearised by digestion with the restriction enzyme Sepl. Plasmid pRAR058, containing synthetic DNA sequence SEQ ID 131 ligated into sites Awl (1981) and AMl (2087) of pG9m-2 (Gen9 Bio.), was digested with restriction enzyme Sapl, resulting in a 3495 bp fragment Plasmid pRAR032, containing synthetic DNA sequence SEQ ID 4 ligated into sites AMrt (1981) and Aarl (2067) of pG9m-2 (Gen9 Bo.), was digested with restriction enzyme Sapl, resulting in a 2837 bp fragment Plasmid pRAR033, containing synthetic DNA sequence SEQ ID 130 ligated into sites Aal (1961) and AMl (2087) of pG9m-2 (Gen9 Bio.), was digested with restriction enzyme Sapl, resulting in a 3495 bp fragment Plasmid pRAR057, containing synthetic DNA sequence SEQ ID 101 ligated Into sites AMl (1981) and AMl (2087) of pG9m-2 (Gen9 Bio.), was digested with restriction enzyme Sapl, resulting in a 3495 bp fragment Plasmid pRAR035, containing synthetic DNA sequence SEQ ID 7 ligated into sites Aal (1981) and Aatl (2087) of pG9m-2 (Gen9 Blo.), was digested with restriction enzyme Sapl, resulting in a 3495 bp fragment Plasmid pDJ33, containing synthetic DNA sequence SEQ ID 31 ligated into sites Aal (1981) and AMl (2087) of pG9m-2 (Gen9 Blo.), was digested with restriction enzyme Sepl, resulting in a 2592 bp fragment Plasmid pDJ82 was obtained as follows: plasmid pDJ80 was created by phosphorylation, annealing and ligation of oligo primers with DNA sequences SEQ ID 132, 133, 134 and 135 with Hindlll/Xbal cut pKC1132. The DNA of Sapl-digested fragments from pRAR033, pRAR057, pRAR035 and BpIA-digested pDJ80 were then assembled using the InFusion cloning kit (Clontech) following the manufacturer's instructions. The reaction mixture was used to transform Stellar chemically competent *E. coli* cells (Clontech) following the manufacturer's instructions, with selection for apramycin resistance. The resulting plasmid, pDJ82 was isolated and confirmed by restriction digestion. Plasmid pDJ83 was obtained as follows: plasmid pDJ79 was created by phosphorylation, annealing and ligation of oligo primers with DNA sequences SEQ ID 138, 137 138 and 139 with HindillIXbal cut pKC1132. The DNA of Sapl-digested fragments from pRAR056, pDJ33, pRAR032 and BpiA-digested pDJ79 were then assembled using the InFusion cloning kit (Clontech) following the manufacturer's instructions. The reaction mixture was used to transform Stellar chemically competent *E. coli* cells (Clontech) following the manufacturer's instructions, with selection for apramycin resistance. The resulting plasmid, pDJ83 was isolated and confirmed by restriction digestion. Plasmid pDJ82 was digested with the restriction enzyme Sapl resulting in a 10,481 bp fragment Plasmid pDJ83 was digested with the restriction enzyme Sapl resulting in an 8,700 bp fragment. The DNA of Sapl-digested fragments from pDJ82 and pDJ83 and Sapl-linearised pRAR030 were then assembled using the InFusion cloning kit (Clontech) following the manufacturer's instructions. The reaction mixture was used to transform Stellar chemically competent *E. coli* cells (Clontech) following the manufacturer's instructions, with selection for ampicillin resistance. The resulting plasmid, pDJ34 was isolated and confirmed by restriction digestion. Plasmid pDJ34 was then digested with Ndel and Xbal, resulting in a 19,992 bp fragment, and ligated with pAW041 (creation as exemplified in example 14), also digested with Ndel and Xbal, to produce the plasmid pDJ35 after selection with apramycin. pDJ35 was digested with Asel and a PCR product generated from pRS416 template (ATCC 87521) and ollgo primers with DNA sequences SEQ ID 15 and 16 inserted using InFusion cloning kit (Clontech) to generate the final plasmid pDJ32. Plasmid pDJ36, containing assembled non-native rapB module 6, was obtained as follows: plasmid pDJ84 was created by phosphorylation, annealing and ligation of oligo primers with DNA sequences SEQ ID 140, 141, 142, 143, 144 and 145 with Hindlll/Xbal cut pKC1132. Plasmid pDJ64, containing the synthetic DNA sequence SEQ ID 146 ligated into sites Awd (1961) and Awd (2067) of pG9m-2 (Gen9 Bio.) was linearised by digestion with the restriction enzyme Sapl, resulting in a 3502 bp fragment Plasmid pDJ25, containing the synthetic DNA sequence SEQ ID 18 ligated into sites Awl (1981) and Aal (2087) of pG9m-2 (Gen9 Blo.) was linearised by digestion with the restriction enzyme Sapl, resulting in a 511 bp fragment Plasmid pDJ37, containing the synthetic DNA sequence SEQ ID 32 ligated into sites Awri (1981) and Aarl (2067) of pG9m-2 (Gen9 Blo.) was linearised by digestion with the restriction enzyme Sapl, resulting in a 1089 bp fragment. The DNA of Sapl-digested fragments from pDJ64, pDJ25 and pDJ37 were then assembled with Bpmll-digested pDJ84 using the InFusion cloning kit (Clontech) following the manufacturer's instructions. The reaction mixture was used to transform Stellar chemically competent *E. coli* cells (Clontech) following the manufacturer's instructions, with selection for apramycin resistance. The resulting plasmid, pDJ36 was Isolated and confirmed by restriction digestion.

Plasmid pDJ38, containing assembled non-native rapC module 12, was obtained as follows: plasmid pDJ85 was created by phosphorylation, annealing and ligation of oligo primers SEQ ID 147, 148, 149, 150, 151 and 152 with Hindlil/Xbal cut pKC1132. Plasmid pDJ29, containing the synthetic DNA sequence SEQ ID 28 ligated into sites AwM (1981) and AMl (2067) of pG9m-2 (Gen9 Blo.) was linearised by digestion with the restriction enzyme Sapl, resulting in a 3364 bp fragment Plasmid pDJ40, containing the synthetic DNA sequence SEQ ID 35 ligated into sites Aal (1981) and Aar (2067) of pG9m-2 (Gen9 Bio.) was linearised by digestion with the restriction enzyme Sapl, resulting in a 506 bp fragment Plasmid pDJ41, containing the synthetic DNA sequence SEQ ID 36 ligated into sites Aarl (1961) and Awri (2087) of pG9m-2 (Gen9 Bio.) was linearised by digestion with the restriction enzyme Sapl, resulting in a 1085 bp fragment. The DNA of Sapl-digested fragments from pDJ29, pDJ40 and pDJ41 were then assembled with BpmI-digested pDJ85 using the InFusion cloning kit (Clontech) following the manufacturer's instructions. The reaction mixture was used to transform Stellar chemically competent *E. coli* cells (Clontech) following the manufacturer's Instructions, with selection for apramycin resistance. The resulting plasmid, pDJ38 was isolated and confirmed by restriction digestion.

Plasmid pDJ38 was cut with Sapl to liberate a 5078 bp fragment corresponding to non-native rapB module 6. pDJ38 was cut with Sapl to liberate a 4931 bp fragment corresponding to non-native rapC module 12. Plasmid pDJ32 was cut with Beel to remove the linker region. The restriction mixtures were resolved by agarose gel electrophoresis and gel slabs containing required DNA fragments excised and purified.

*Saccharomyces cerevisiae* is transformed, positive clones selected and DNA extracted from clones as described in Shao and Zhao (2013) and example 2. Plasmid DNA Is transformed in to *E. coli* DH10B for library creation as described in example 2. This library can be used to transform conjugation strain ET12587 carrying plasmid pUZ8002. Contrary to regular transformation the cells are not plated out onto agar. Instead they are used as a starter culture for conjugation, replacing the overnight culture described in the procedure above (see general methods). These can be used to conjugate strains such ISOM-5032, ISOM-5033, ISOM-5034 or ISOM-5035.

Example 16: Generation of a Rapamycin-Based Library by Contraction of Native rapB-Encoding Sequence Using *Saccharomyces cerevisiae* In Vivo Homologous Recombination In this experiment, yeast recombination Is used to generate contracted variants of native full-length mpB that have undergone recombination in the recombination 'hotspots' disclosed in this document. Again, novel rapamycin analogues are generated by complementing a rapB gene knockout, which encodes modules 5-10, with the variant rapB genes.

Plasmid pDJ93, containing full-length native rapB, was obtained as follows: a PCR product containing the rop gene was generated using oligo primers with DNA sequences SEQ ID 153 and 154 and template plasmid pET29b+ (Novagen) and inserted in to Pcil-cut pSGK118 (a rapB expression plasmid created by standard cloning methods of generating multiple PCR products spanning the length of rapB and ligation to create the full gene; SEQ ID 155) by InFusion cloning (Clontech) following manufacturer's instructions. The reaction mixture was used to transform Stellar chemically competent *E. coli* cells (Clontech) following manufacturer's instructions, with selection for apramycin resistance. The resulting plasmid, pRAR143, was isolated and confirmed by restriction digestion. A PCR product was generated using oligo primers with DNA sequences SEQ ID 156 and 157 and template plasmid pRS418 (ATCC 87521) and this was inserted in to Pcil-cut pRAR143 by InFusion cloning (Clontech) following manufacturer's instructions. The reaction mixture was used to transform Stellar chemically competent *E. coli* cells (Clontech) with selection for apramycin resistance. The resulting plasmid, pDJ93, was isolated and confirmed by restriction digestion. pDJ93 was linearised by cutting once within rapB using restriction endonuclease SnaB1 or EcoRL. Unearised plasmid was resolved by agarose gel electrophoresis and the gel slab containing DNA excised and purified.

*Saccharomyces cerevisiae* was transformed with linearised pDJ93, positive clones selected and DNA extracted from clones as described in Shao and Zhao (2013) and example 2. Plasmid DNA was transformed in to *E. coli* DH10B for library creation as described in example 2. This library can be used to transform conjugation strain ET12567 carrying plasmid pUZ8002. Contrary to regular transformation the cells are not plated out onto agar. Instead they are used as a starter culture for conjugation, replacing the overnight culture described in the procedure above (see general methods). These can be used to conjugate strains such ISOM-5032, ISOM-5033, ISOM-5034 or ISOM-5035.

Example 17: Generation of a Rapamycin-Based Library Using *Saccharomyces* Cerevialae in Vivo Homologous Recombination of Native rapB-Encoding Sequence and Additional Native Rapamycin Sequence In this experiment, yeast recombination is used to generate variants of native rapB that have undergone recombination in the recombination 'hotspots' disclosed in this document. Recombination occurs between rapB and additional PKS sequence, including but not limited to, that from *rapA*, rapB or rapC. Again, novel rapamycin analogues are generated by complementing a rapB gene knockout, which encodes modules 5-10, with the variant rapB genes.

Plasmid pDJ93 is obtained as described in example 16 and is linearised using restriction endonuclease SnaBl or EcoRl. Additional rapamycin PKS sequence (either single module or consecutive modules) is obtained by digestion of pSGK103 (repC) or pSGK110 (*rapA*) (expression plasmids created by standard cloning methods of generating multiple PCR products spanning the length of rapC and *rapA* and ligation to create the full genes). A 6018 bp continuous DNA fragment starting within KS13 and ending within KS14 is generated by digestion of pSGK103 (SEQ ID 159) with EcoRl. A 13,508 bp continuous DNA fragment starting within DH1 (first chain-extending module) and ending in the pre-ACP3 region is generated by digestion of pSGK110 (SEQ ID 158) with Sphl. A 13,959 bp continuous DNA fragment starting within the pre-ACP11 region and ending within ACP14 Is generated by digestion of pSGK103 (SEQ ID 159) with Xmnl. In this way, a variety of rapamycin module-encoding pieces are generated using appropriately chosen restriction enzymes. This method can be extended to include module-encoding sequence from heterologous PKS genes, including but not limited to that of the tacrolimus PKS genes from *S. tsukubeensis*.

Linearised pDJ93 and additional rapamycin PKS pieces are resolved by agarose gel electrophoresis and gel slabs containing desired DNA excised and purified. Saccheromyces cerevisiae is transformed with linearised pDJ93 and either the 6018 bp fragment, the 13,508 bp fragment or the 13,959 bp fragment or any combination of fragments. Positive clones are selected and DNA extracted from clones as described in Shao and Zhao (2013) and example 2. Plasmid DNA is transformed in to *E. Coli* Dh10B for library creaion as described in example 2. This library can be used to transform conjugation strain ET12567 carrying plasmid pUZ8002. Contrary to regular transformation the cells are not plated out onto agar. Instead they are used as a starter culture for conjugation, replacing the overnight culture described in the procedure above (see general methods). These can be used to conjugate strains such ISOM-5032, ISOM-5033, ISOM-5034 or ISOM-5035.

Figure 13:
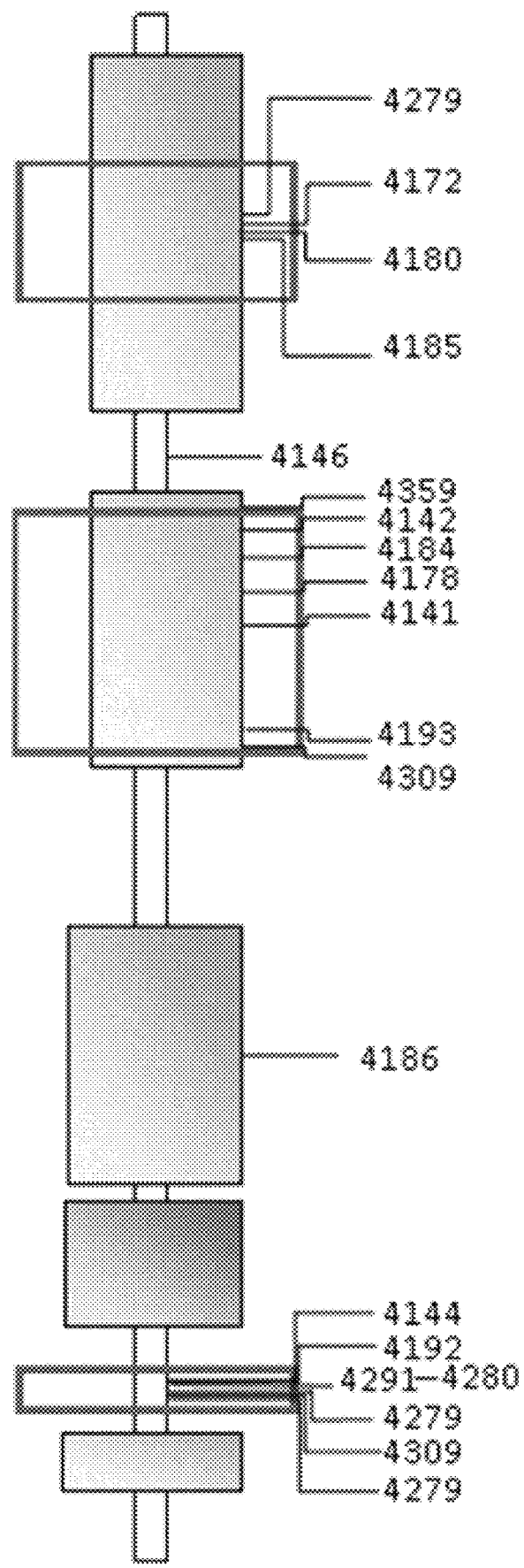
FIG. 13: A pictorial representation of the junctions within the hybrid PKS seen following sequencing a number of bacterial strains containing productive hybrid rapamycin PKS genes.
Figure 15A:
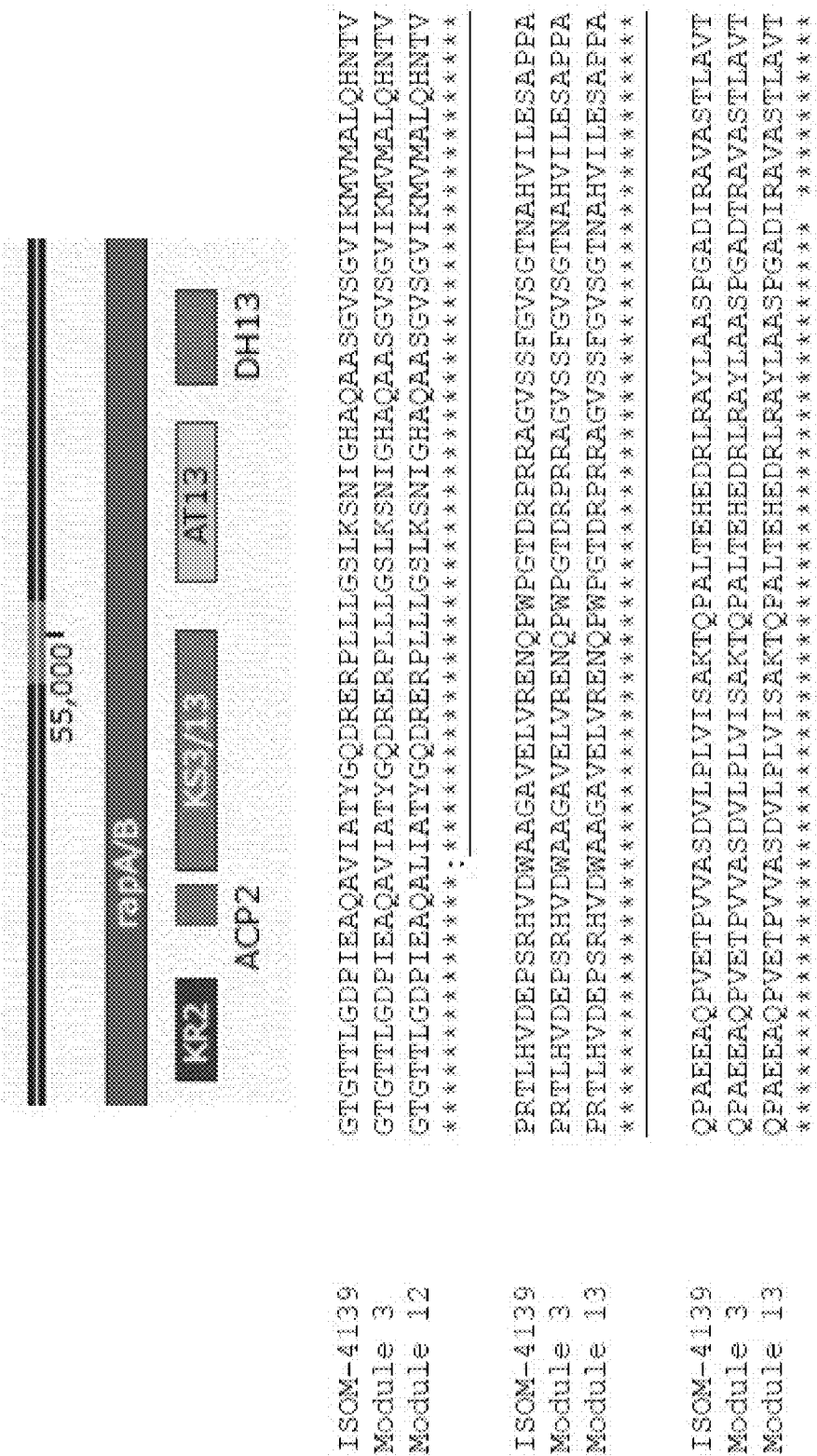
Figure 15B:
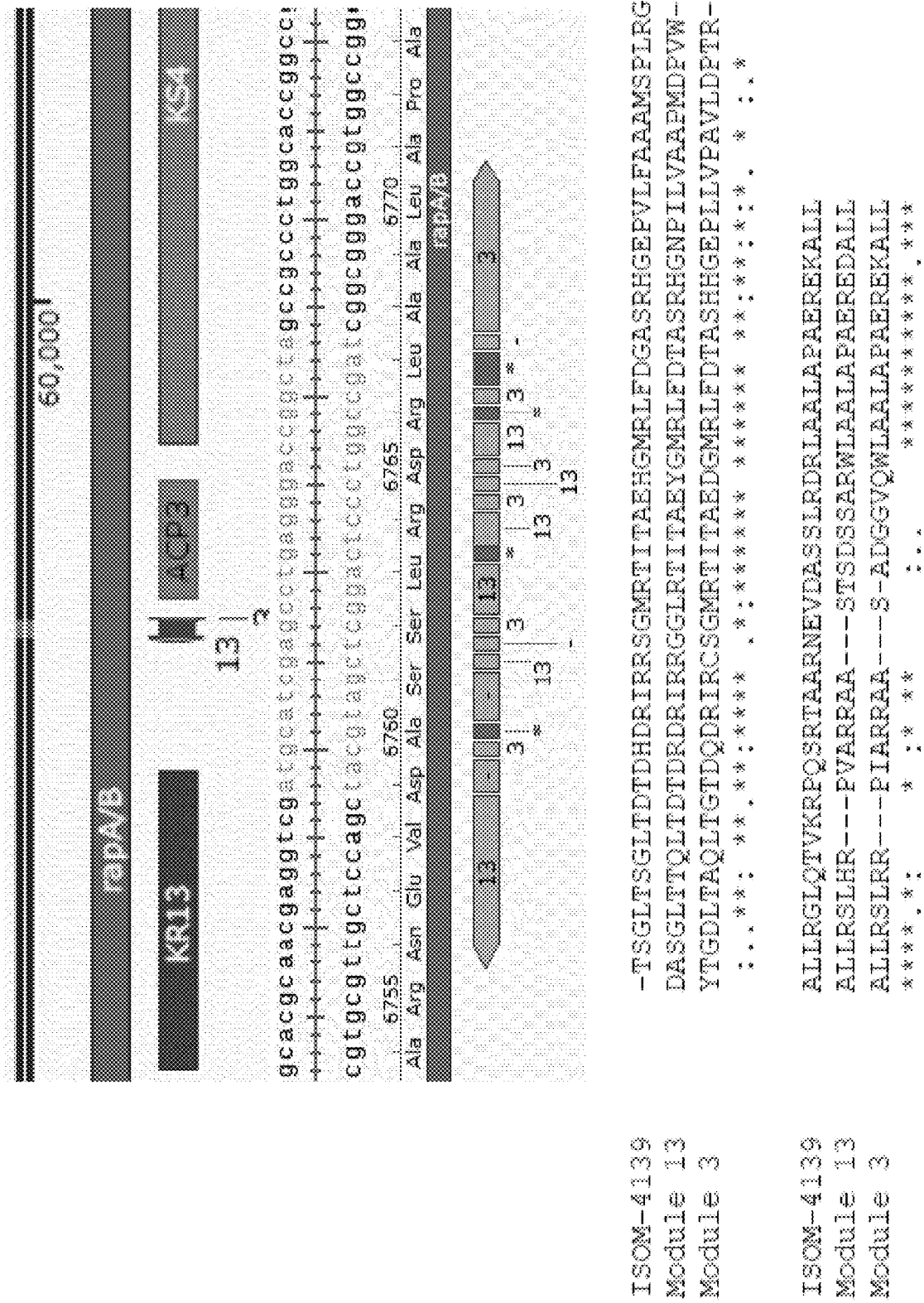
Figure 15C:
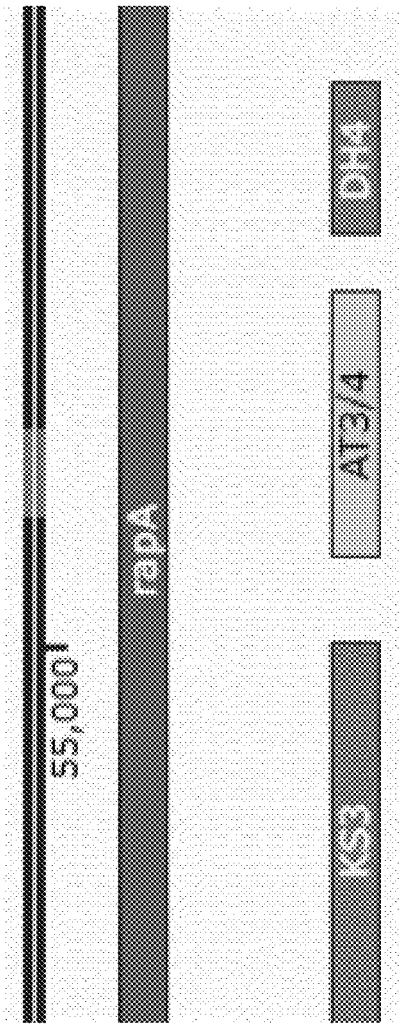
Figure 15E:
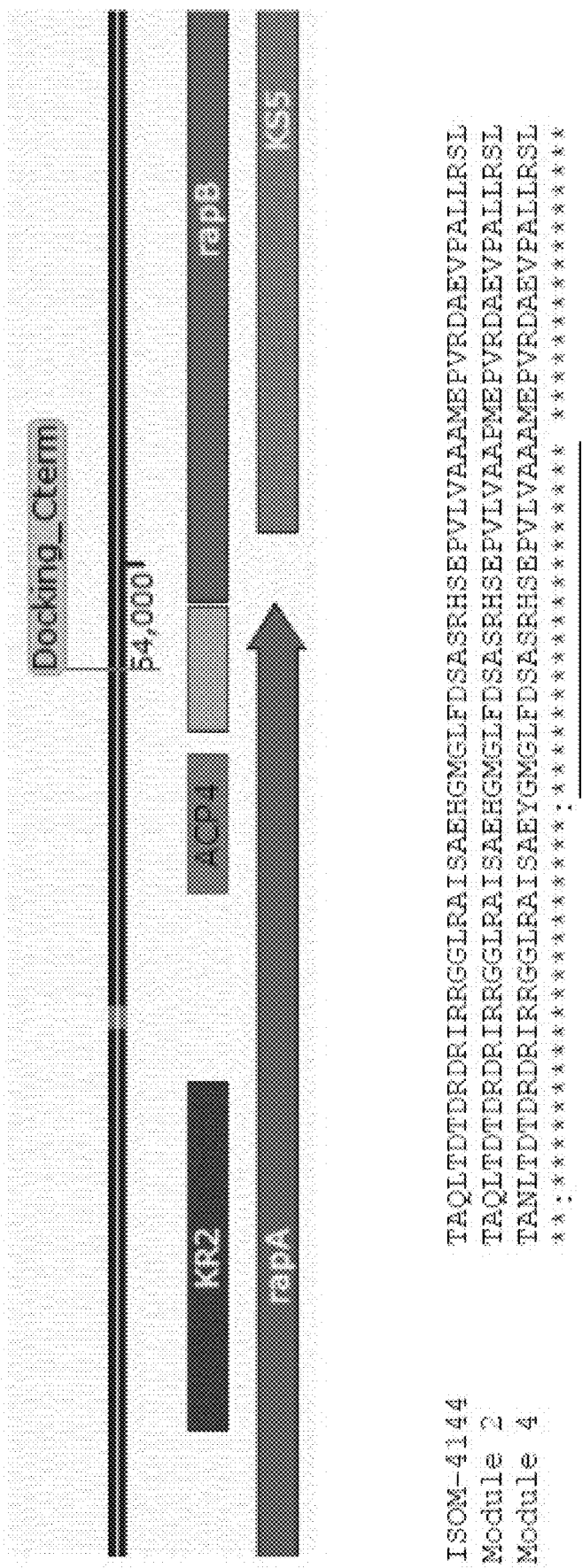
Figure 15F:
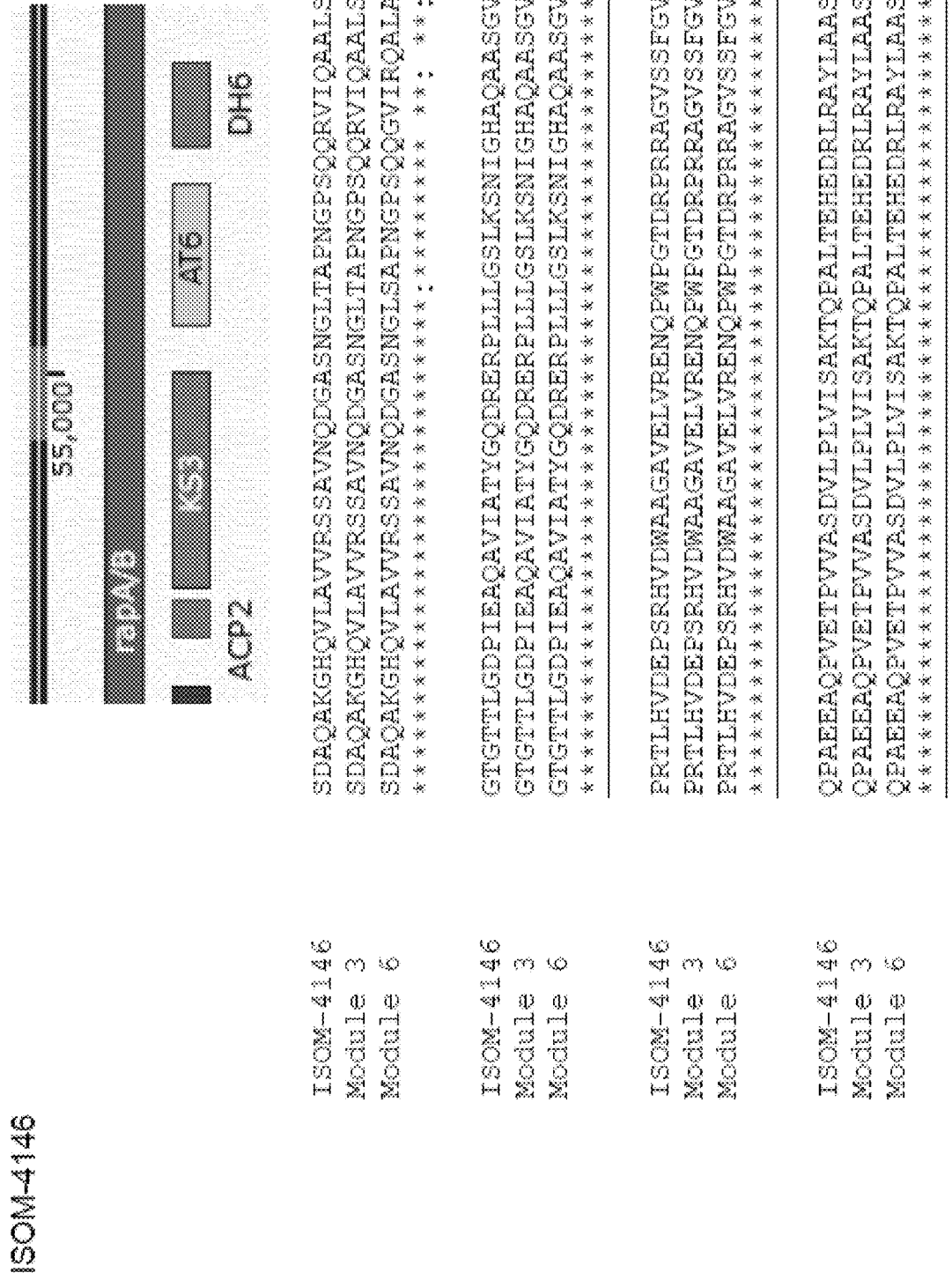
Figure 15J:
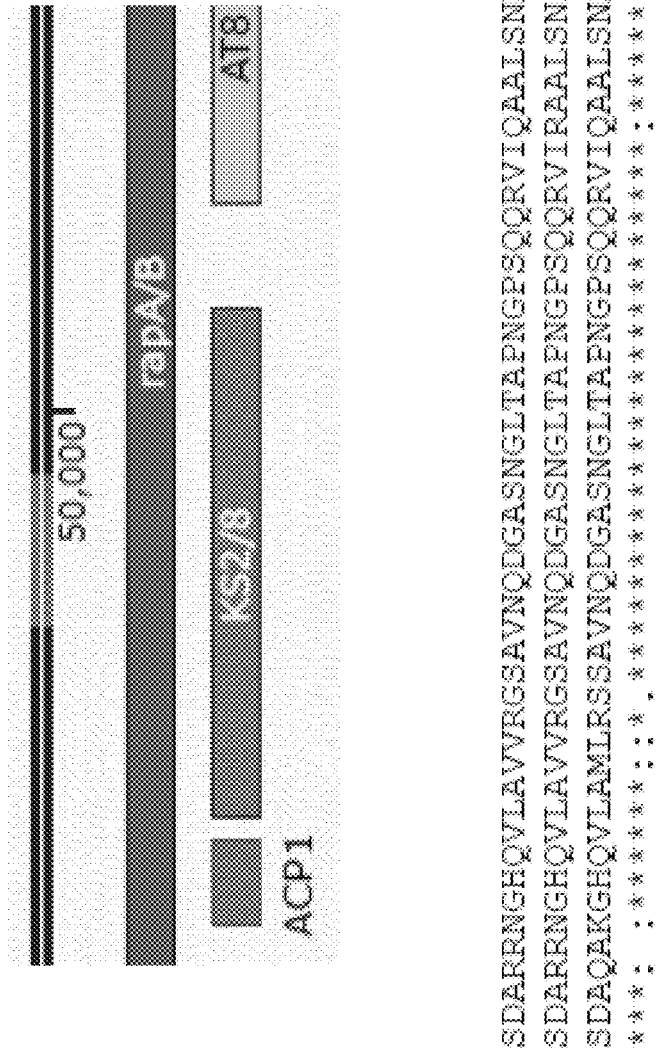
Figure 150:
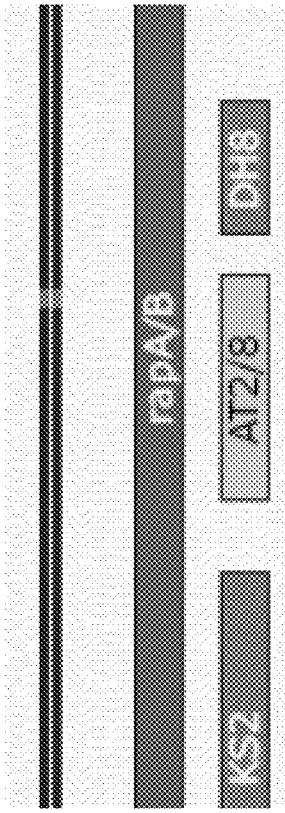
Figure 15U:
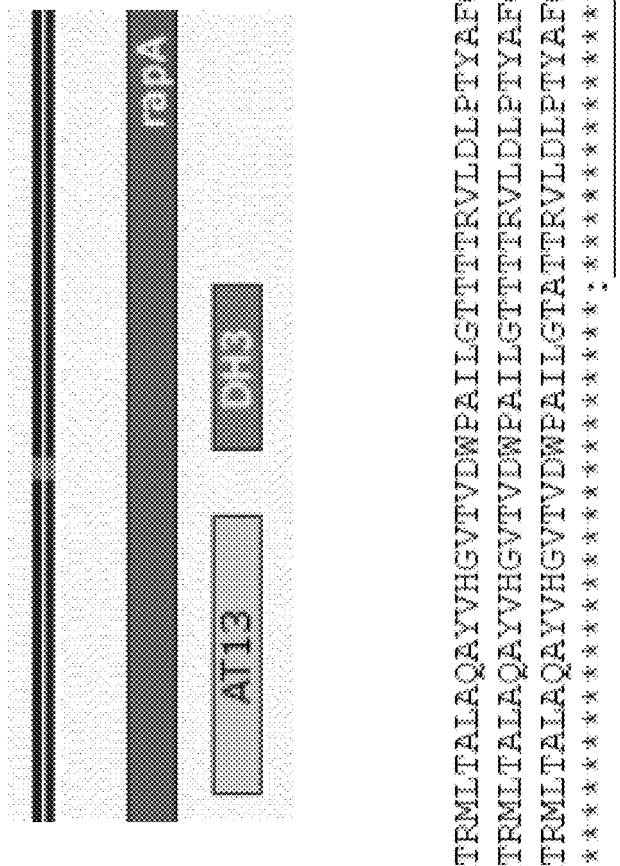
FIG. 15U: ISOM-4867-SEQ ID NO: 317; ISOM-4867 Module 13-SEQ ID NO: 318; ISOM-4867 Module 3-SEQ ID NO: 319.
Figure 15X:
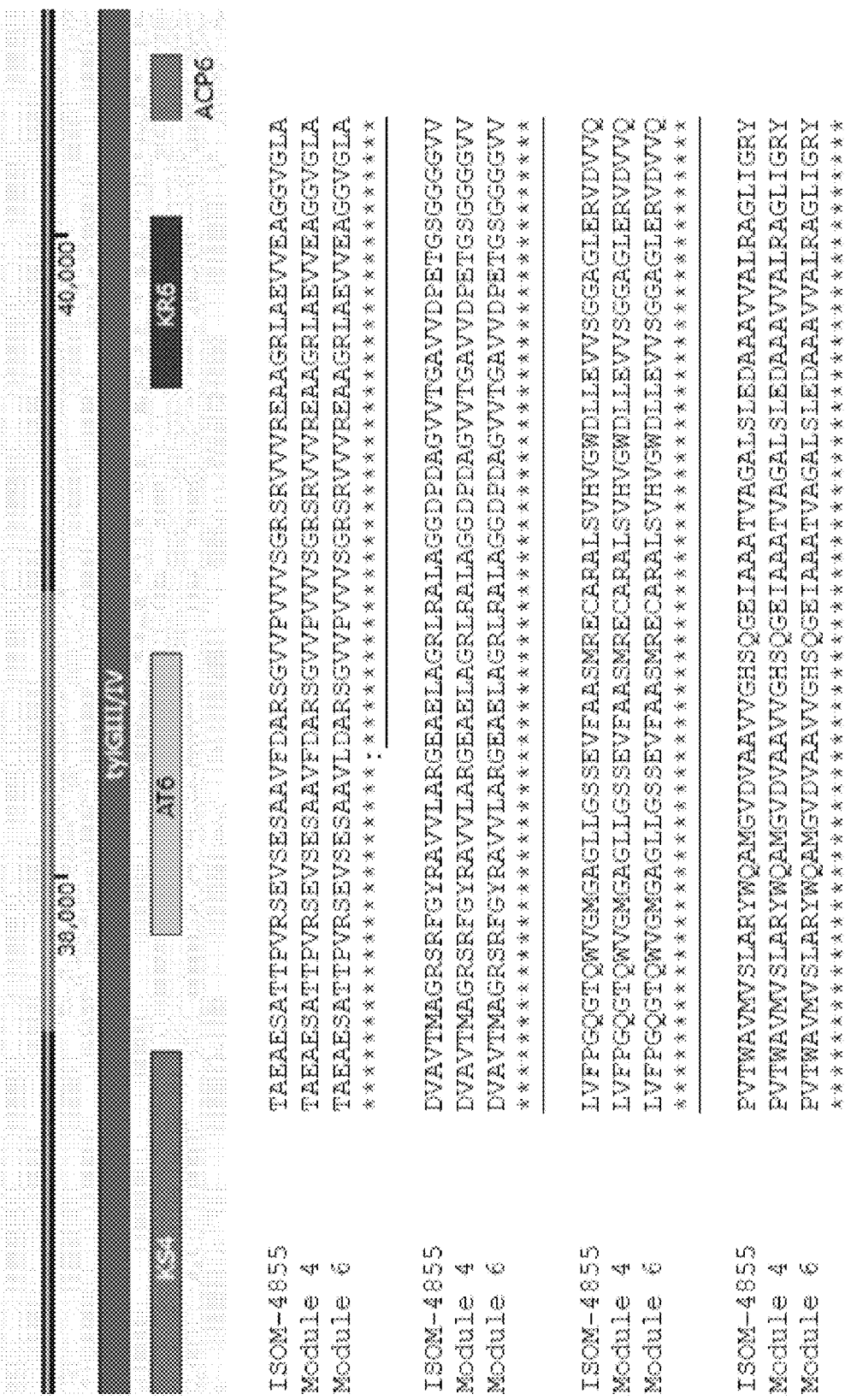
Figure 15B:
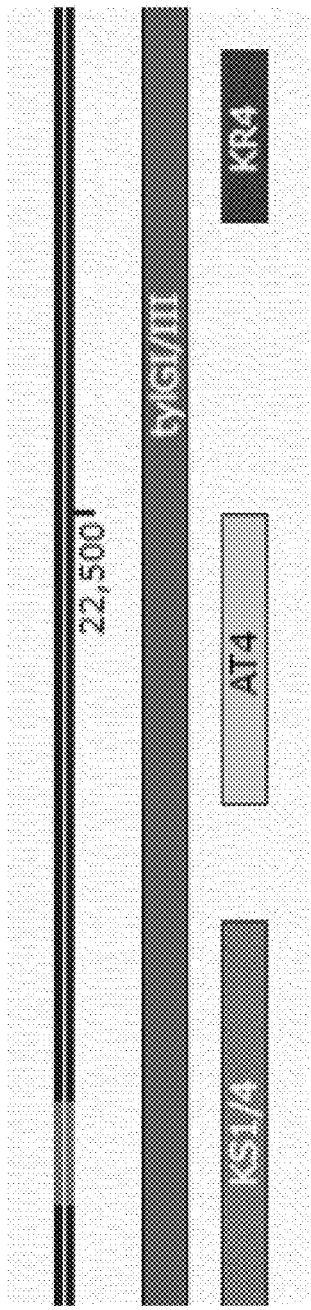

Example 18: Sequence Analysis of Junction Sites on Strains Expressing Hybrid PKS The genome sequences of a series of mutant bacterial strains containing functional hybrid rapamycin and tylosin PKS modules were generated by standard DNA sequencing and assembly methods. The junctions were located by multiple sequence alignments between the standard unmodified rapamycin or tylosin PKS and the mutant PKS. Amino acid sequences of hybrid PKS modules were aligned, using Clustal Omega, with those of the module whose amino acid sequence the hybrid module is identical to on the N-terminal side of the junction and of the module whose amino acid sequence the hybrid module is identical to on the C-terminal side of the junction. The junction site of the hybrid PKS module was defined as the sequence flanked by the last mismatch between the hybrid module and the C-terminal module, and the first mismatch between the hybrid module and the N-terminal module. Results are shown in FIG. 15, where the junction area is underlined underneath the alignment. Asterisks show identical amino acids, whilst hyphens show the region anticipated to contain the junction. Similar analysis led to the information shown in FIGS. 13, 14 and 16.

An overview of the junctions from each of the strains is as follows:

| | | Rapamycin PKS | | | | Tylosin PKS | |
|---|---|---|---|---|---|---|---|
| Strain | Domain | Upstream module | Downstream module | Strain | Domain | Upstream module | Downstream module |
| 4139 | KS | 3 | 13 | 4854 | AT | 4 | 6 |
| | KR-ACP | 13 | 3 | 4855 | AT | 4 | 6 |
| 4141 | AT | 3 | 4 | 4897 | AT | 4 | 6 |
| 4142 | AT | 3 | 6 | 5004 | KS | 1 | 4 |
| 4144 | KR-ACP | 2 | 4 | 5005 | AT | 4 | 6 |
| 4146 | KS | 3 | 6 | 5008 | AT | 1 | 4 |
| 4172 | KS | 3 | 6 | 5009 | AT | 2 | 6 |
| 4176 | AT | 6 | 7 | 5010 | AT | 2 | 6 |
| 4178 | AT | 3 | 7 | 5051 | AT | 0 | 6 |
| 4180 | KS | 2 | 8 | 5054 | AT | 2 | 6 |
| 4184 | AT | 2 | 8 | | | | |
| 4185 | KS | 3 | 6 | | | | |
| 4186 | ER | 1 | 7 | | | | |
| 4192 | KR-ACP | 2 | 5 | | | | |
| 4193 | AT | 2 | 8 | | | | |
| 4279 | KR-ACP | 2 | 3 | | | | |
| | KS | 4 | 7 | | | | |
| 4280 | KR-ACP | 2 | 3 | | | | |
| 4291 | KR-ACP | 2 | 3 | | | | |
| 4359 | AT | 1 | 6 | | | | |
| 4867 | AT-ACP | 2 | 11 | | | | |
| | AT-DH | 13 | 3 | | | | |

Example 19: Application of a Selection System in Combination with Accelerated Evolution Method for Effective Generation of a Library of Strains Producing Compounds Interacting with Both mTOR and FKBP12 (FKBP1a)

Plasmids pAW304 and pAW302 were generated as described in Example 5B and ISOM-5578 was generated by conjugation of both pAW304 and pAW302 Into ISOM-3410 (Kendrew et al. 2013) as described in general methods section. An Intermediate plasmid pAW313 was derived from the pKC1139 shuttle vector (Bierman et al., 1992) as follows: a mutation was introduced using a pair of mutagenic primers: ctccaccgctgatgacatatgtcgatcatagcacgatc (SEQ ID NO 180) and gatcgtgctatgatcgacatatgtcatcagcggtggag (SEQ ID NO 161) to introduce an additional NdeI cut site and then gtcgattggctgagcactagtcatgagcggagaac (SEQ ID NO 182) and gttctccgctcatgaactagtgctcagccaatcgac (SEQ ID NO 163) to Introduce an SpeI site. Briefly, to introduce the mutations, the 0.5 pM mutagenic primer pairs were used stepwise to perform a PCR using a high fidelity DNA polymerase from CloneAmpM HIFI PCR Premix in the presence of 10% DMSO as instructed in the manual. Briefly, 0.1 uL of plasmid purified using QIAprep Spin Miniprep Kit was mixed with 2.5 uL DMSO, 9 uL water, 0.5 uL of first primer diluted to 10 pM and 0.5 uL of second primer diluted to 10 pM were mixed with 12.5 uL CloneAmp™ HiFi PCR Premix. The PCR programme was set up according to the polymerqase provider manual, with the annealing temperare set up to 50° C., and the elongation step of the cycle was set up to 7 minutes. The PCR product was digested with 1 uL DpnI restrictases to remove any undigested plasmid, and the enzyme was deactivated at 80° C. for 20 min. Then, *E. coli* HST08 were transformed with 1 uL of the resultant product, and the successful clones were selected using restriction enzyme digest. Same procedure was applied on the product to introduce the second site. A spectinomycin resistance cassette was ordered and delivered from gen9bio, where the intended synthetic DNA cassette (SEQ ID 164) was inserted between Aerl (1961) and Aarl (2067) sites by the product supplier (gen9bio) to form an intermediate plasmid pAW093.

A band was amplified from the above plasmid using a primer pair pML005.FOR GGTACCCATATGatgagg-gaagcggtgatcgccgaag (SEQ ID NO 165) and pML005.REV GCGGCCGCACTAGTttatttgccgactaccttggt (SEQ ID NO 166) to form a product containing a truncated version (818 bp) of the cassette. Briefly, 0.5 uL of plasmid purified using QIAprep Spin Miniprep Kit was mixed with 2.5 uL DMSO, 8.5 uL water, 0.5 uL of first primer diluted to 10 pM and 0.5 uL of second primer diluted to 10 pM were mixed with 12.5 uL CloneAmp™ HiFi PCR Prembx. The PCR programme was set up according to the polymerqase provider manual, with the annealing temperare set up to 50° C., and the elongation step of the cycle was set up to 3 minutes. The resultant product was separated on 1% agarose gel in 0.5x TBE system, and the band of Interest (818 bp) was excised from the gel and extracted using Nucleospin Gel arid PCR Clean-up kit (Macherey Nagel). 15 uL of the resultant product was mixed with 1.5 uL Ndel (NEB) and 1.5 uL Spel, 3 uL of CutSmart buffer (10x, NEB) and 9 uL water. The digestion was incubated for 1 hour at 37 deg C. and inactivated at 75 deg C. for 5 minutes. The fragment was introduced by ligation between Ndel and Spel sites of pAW313 to generate an Intermediate plasmid pML003. Briefly, the 6 uL of digested PCR product mentioned above was mixed with 1 uL backbone digested with Ndel and Spel, mixed with 1 uL ligase $T_4$ (NEB), 2 uL ligase buffer and 10 uL water. The mixture was incubated for 10 minutes at room temperature and deactivated at 65° C. for 10 minutes, and 5 uL of the product was used for transformation by heat-shock into E. coli HST08. The transformants were plated for selection onto 2TY medium with 50 pg/mL spectinomycin for selection. The clones were screened using restriction digest and confirmed by Sanger sequencing and taken forward.

A homology fragment from a rapB gene was amplified from genomic DNA of ISOM-3410 (isolated using MP Biomedical FastDNA spin kit for soil as described in general methods) using a primer pair AW370 (ggccagtgc-caagctccgagcgaccgg (SEQ ID NO 167) and AW371 acat-gattacgaattgcggtattgggc (SEQ ID NO 168)) and cloned Into pML003 between Hindlll and EcoRI sites by InFusion cloning to generate pML007. Spores of S. rapamyciricus ISOM-5578 generated as described above were subsequently conjugated with plasmid pML007 and a conjugation methodology described in W62015/004458 was applied. Briefly, plasmid was electroporated into ET12567:pUZ8002 and selected on 2TY agar medium containing spectinomycin (50 pg/mL), kanamycin (25 pg/mL), and chloramphenicol (25 pg/nL). Single colonies were grown overnight in 3 ml 2TY liquid medium containing spectinomycin (50 pg/mL), kanamycin (25 pg/mL) and chloramphenicol (25pg/ml). 0.7 ml of this culture was used to inoculate 10 ml liquid medium containing spectinomycin (50pg/m), kanamycin (251pg/ml) and chloramphenicol (25 pg/mL) and grown at 37 C to reach an OD of approximately 0.5. Cells were pelleted at 4000 rpm for 10 minutes and washed twice with 10 ml 2xTY before resuspending in 0.25 mL 2 TY. Spores of S. rapamycinicus were grown on ISP3 for 2-3 weeks were harvested using 20% glycerol and stored at −80° C. (1 plate gives about 1 mL spore stock). For the conjugation approximately 0.3-0.5 mL of these spores are needed for each conjugation. Spores were unfrozen and pelleted by centrifugation (4000 rpm, 10 minutes) before washing with 2xTY. The spores were then repelleted and resuspended in 0.25 mL 2xTY and heat shocked in a water bath at 50° C. for 10 minutes before cooling immediately on ice. The conjugation was performed by adding 0.25 mL of washed E. coli cells to the heat shocked spores, mixing and spreading the mixture onto a R6 plate and transferring to 37° C. The plate was overlaid with 2 mL water containing 15 pL nalidbdc acid (stock 50 mg/mL) after 2-3 hours and with 2 mL water containing 15 pL spectinomycin (stock 100 mg/mL) after an overnight incubation.

Plates were incubated at 37° C. until single exconjugant colonies were visible. Colonies (approximately 15-20) were patched to MAM containing spectinomycin and nalidixic acid and reincubated at 37° C. These colonies were then repatched to the same media (containing spectinomycin and nalidixic acid) to ensure there was no E. coli contamination. Once stabilised, approximately 10-15 of the strains were patched to solid ISP3 media lacking antibiotics and Incubated at 37° C. for approximately 3 days before repatching to ISP3 media and growing for a further 3 or 4 days. A final round of subculture at 37° C. on ISP3 was performed before plating to ISP3 and leaving at 28° C. for to allow the strain to sporulate (−10-14 days). Spores were harvested in 20% glycerol and a dilution series prepared in water inoculated into RapV7 medium. After 48 hours the aliquot of the culture was used to inoculate a secondary seed falcon with RapV7 medium and 50 pg/mL apramycin. After 48 hours the medium was used to inoculate 7 mL RapV7 with 50 pg/mL apramycin. After 48 hours the medium was used to Inoculate 7 mL MD6 production medium. The analytical sample of the broth was processed according to the general methods and peaks for novel products were observed.

Example 20: Generation of Constructs for Selection of Cells Producing Compounds Interacting with Both Calcineurin and FKBP12 (FKBP1a) Obtained Through Accelerated Evolution Method Plasmids pAW317 and pAW302 were generated as described in Example 5B and ISOM-5803 was generated by conjugation of pAW304 and pAW302 to ISOM-3410 (Kendrew et al., 2013) from E. coli ET12567/pUZ8002 from as described in Example 5B. Spores of S. rapemycinicus ISOM-5803 are subsequently conjugated with the pKC1139-based plasmid pML007, using the conjugation protocol described in Example 19, to generate a primary integrant into the rapamycin PKS gene in ISOM-5906. Briefly, the plasmid is electroporated into ET12587: pUZ8002 and selected on 2TY agar medium containing spectinomycin (50 pg/mL), kanamycin (25 pg/mL), and chloramphenicol (25 pg/mL). Single colonies are grown overnight in 3 ml 2TY liquid medium containing spectinomycin (50 pg/mL), kanamycin (25 pg/mL) and chloramphenicol (25pg/ml). 0.7 ml of this culture is used to inoculate 10 ml liquid medium containing spectinomycin (50pg/ml), kanamycin (25pg/ml) and chloramphenicol (25 pg/mL) and grown at 37 C to reach an OD of approximately 0.5. Cells are pelleted at 4000 rpm for 10 minutes and washed twice with 10 ml 2xTY before resuspending in 0.25 mL 2 TY. Spores of S. rapemycinicus ISOM-5803 grown on ISP3 for 2-3 weeks are harvested using 20% glycerol and stored at −80° C. (1 plate gives about 1 mL spore stock). For the conjugation approximately 0.3-0.5 mL of these spores are needed for each conjugation. Spores are unfrozen and pelleted by centrifugation (4000 rpm, 10 minutes) before washing with 2xTY. The spores are then repelleted and resuspended in 0.25 mL 2xTY and heat shocked in a water bath at 50° C. for 10 minutes before cooling immediately on ice. The conjugation is performed by adding 0.25 mL of washed E. coli cells to the heat shocked spores, mixing and spreading the mixture onto a R8 plate and transferring to 37° C. The plate is overlaid with 2 mL water containing 15 μL naldixic acid (stock 50 mg/mL) after 2-3 hours and with 2 mL water containing 15 μL spectinomycin (stock 100 mg/mL) after an overnight incubation.

Plates are incubated at 37° C. until single exconjugant colonies are visible. Colonies (approximately 15-20) are patched to MAM containing spectinomycin and nalidixic acid and reincubated at 37° C. This colony is then repatched to the same media (containing spectinomycin and nalidixic acid) to ensure there was no E. coli contamination. Once stabilised approximately 10-15 of the strains are patched to solid ISP3 media lacking antibiotics and Incubated at 37° C. for approximately 3 days before repatching to ISP3 media and growing for a further 3 or 4 days. A final round of subculture at 37° C. on ISP3 is performed before plating to ISP3 and leaving at 28° C. for to allow the strain to sporulate (–10-14 days). Spores are harvested in 20% glycerol and a dilution series prepared in water and spread onto solid MDB media with increasing concentrations of apramycin before incubating at 28° C.

Strains are grown for confirmation in RapV7 seed medium without the antibiotic selection (7 mL) in a Falcon tube (50 mL) plugged with a foam bung and cultured at 28° C. and 300 rpm (2.5 cm throw) for 48 h. MDO production media (7 mL) is inoculated with this seed culture (0.35 mL) using a wide-orifice tip and fermented for 3 days at 2° C. and 300 rpm (2.5 cm throw). Among the strains that no longer produced the original compound strains that produced novel compounds were Identified.

Example 21: Generation of a Selection System for Selection of mTOR Inhibitors Based on Previously Contracted Rapamycin ISOM-4359 (previously described as phenotype F from BIOT-4827 (WO20151004458), deposited at the NCIMB strain coliection as NCIMB 42152), Is a contracted rapamycin analogue producer obtained through the methods described in VO2015/004458. Plasmids pAW304 and pAW302 were generated as described in Example 5B and ISOM-5908 was generated by conjugation of pAW304 and pAW302 into ISOM-4359. The plasmid for Inducing recombination and diversity, pAW324 was derived from pML003. This plasmid contains a homology region to Module 6/7 of rapB amplified from genomic DNA and cloned between Hindlll and EcoRI sites using InFusion cloning. This plasmid was used for accelerated evolution of ISOM-5908 as described in Example 20 and WO2015/004458, except the spectinomycin Is used instead of apramycin as a marker for primary integrant selection.

Briefly, Spores of S.rapamycinicus ISOM-5908 are subsequently conjugated with the pKC1139-based plasmid pML007, using the standard conjugation protocol, to generate a primary integrant into the rapamycin PKS gene: the plasmid is electroporated into ET12567:pUZ8002 and selected on 2TY agar medium containing spectinomycin (50 pg/mL), kanamycin (25 pg/mL), and chloramphenicol (25 pg/mL). Single colonies are grown overnight in 3 ml 2TY liquid medium containing spectinomycin (50 pg/mL), kanamycin (25 pg/nL) and chloramphenicol (25pg/ml). 0.7 ml of this culture is used to inoculate 10 ml liquid medium containing spectinomycin (50pg/ml), kanamycin (25pg/ml) and chloramphenicol (25 pg/mL) and grown at 37 C to reach an OD of approximately 0.5. Cells are pelleted at 4000 rpm for 10 minutes and washed twice with 10mI 2xTY before resuspending in 0.25 mL 2 TY. Spores of S. rapamycirAcus ISOM-5803 grown on ISP3 for 2-3 weeks are harvested using 20% glycerol and stored at –80° C. (1 plate gives about 1 mL spore stock). For the conjugation approximately 0.3-0.5 mL of these spores are needed for each conjugation. Spores are unfrozen and pelleted by centrifugation (4000 rpm, 10 minutes) before washing with 2xTY. The spores are then repelleted and resuspended in 0.25 mL 2xTY and heat shocked in a water bath at 50C for 10 minutes before cooling immediately on ice. The conjugation is performed by adding 0.25 mL of washed E. cofi cells to the heat shocked spores, mixing and spreading the mixture onto a R6 plate and transferring to 37° C. The plate is overlaid with 2 mL water containing 15 μL nalidixic acid (stock 50 mg/mL) after 2-3 hours and with 2 mL water containing 15 μL spectinomycin (stock 100 mg/mL) after an overnight incubation.

Plates are incubated at 37° C. until single exconjugant colonies are visible. Colonies (approximately 15-20) are patched to MAM containing spectinomycin and nalidixic acid and reincubated at 37° C. This colony Is then repatched to the same media (containing spectinomycin and nalidixic acid) to ensure there was no E. coli contamination. Once stabilised, approximately 10-15 of the strains are patched to solid ISP3 media lacking antibiotics and incubated at 37° C. for approximately 3 days before repatching to ISP3 media and growing for a further 3 or 4 days. A final round of subculture at 37° C. on ISP3 is performed before plating to ISP3 and leaving at 28° C. for to allow the strain to sporulate (–10-14 days). Spores are harvested in 20% glycerol and a dilution series prepared in water and spread onto solid MD8 media with increasing concentrations of apramycin before incubating at 28° C.

Strains are grown for confirmation in RapV7 seed medium without the antibiotic selection (7 mL) in a Falcon tube (50 mL) plugged with a foam bung and cultured at 28° C. and 300 rpm (2.5 cm throw) for 48 h. MD8 production media (7 mL) is inoculated with this seed culture (0.35 mL) using a wide-orifice tip and fermented for 3 days at 26° C. and 300 rpm (2.5 cm throw). Among the strains that no longer produced the original compound strains that produced novel compounds are Identified with increased affinity to mTOR in comparison to the product of ISOM-4359.

Example 22: Disrupted Rapamycin

In this experiment, the starting point for accelerated evolution and selection is a non-productive, disrupted PKS, generated using plasmid pAW404.

Briefly, the plasmid pAW402 was designed to contain two homology regions flanking a 'disruption casette' containing a transcriptional terminator, a GusA under ErmE* and another transcriptional terminator. The plasmid confers capreomycin resistance due to presence of the cassette cph amplified from Saccharothrix mutabilis subsp. capreolus. Intermediate plasmid pAW340 is generated by inFusion cloning synthetic cassette ordered from IT DNA gacggccagt-gaattcGCTAGCgactcctgttgatagatccagtaatgacctcagaactc-catctggatttgWtcagaacgctcggtt gccgccgggcgtttttattggt-gagaatatACTAGTGTTCTAGAccaggcatcaaataaaacgaaaggt-cagtcgaaaga ctgggccttcgttttatctgttgtttgtcggtgaacgctctc-tactagagtcacactggctcacctcgggtgggcttctggtAGATCT ttataagcttggcgtaatca (SEQ ID NO 169) betweem EcoRl and Hindlll sites of pUC19, briefly synthetic DNA as delivered by the provider was mixed with 50 uL water, and 5 uL of the resultant mixture is used for the InFusion cloning procedure. The vector backbone is prepared by double digestion of pUC19 with Hindlll-HF and EcoRl-HF in buffer CutSmart (NEB). Post digestion the product underwent gel electrophoresis on 1% agarose gel in 0.5x TBE system. The 2635 bp band was excised from the gel and Isolated using the NucleoSpin® Gel and PCR Clean-up kit.1 uL of the synthetic DNA mentioned above was mixed with 0.5 uL of the vector band, 2 uL of the InFusion premix, and the reaction was performed at 50 deg C. for 15 minutes. 1 uL of the product is mixed with 50 uL aliquot of *E. coli* HST08 cells and the heat-shock procedure is performed, followed by plating on 2TY with 50 pg/mL ampicillin for selection. The correct clones are selected on the basis of a double digest and Sanger sequencing.

Then a fragment containing the GusA cassette is amplified from the described above intermediate plasmid pAW338 using primer pair AW397 gtgagaaatatACTAGTctagt-catgcgagtgtc (SEQ ID NO 170) and AW398 tgatgcctggTCTAGAgatctggtctagtttactg (SEQ ID NO 171). Briefly, the PCR reaction was performed using the primers mentioned above (0.5 uL of 10 pM primer solutions per reaction) in the presence of 10% DMSO. After the reaction the PCR products were separated on 1% agarose gel in 0.5x TBE system. The 2047 bp fragment was identified on gel, and isolated from the gel using NuceoSpinM Gel and PCR Clean-up (Macheray-Nagel). The plasmid was made using InFusion cloning: the band implicated above and the vector backbone were mixed with 2 uL InFusion premix and water and were incubated at 50° C. for 15 minutes. The *E. coli* HST08 cells were transrmed using heat-shock procedure with 0.5 uL InFusion product, and the correct clones were identified by restriction digest and Sanger sequencing.

Intermediate plasmid pAW338 as follows: a 1814 bp fragment is cut out using Nde and Spel in CutSmart buffer (NEB) from an intermediate plasmid pAW341 containing synthetic cassette ordered from Genewiz (SEQ ID NO 172). The sample after digestion underwent a gel electrophoresis on 1% agarose gel in 0.5x TBE buffer. The band of 1814 bp was isolated from the gel using Macherey-Nagel gel extraction kit and eluted in 30 uL water. The band is then ligated using $T_4$ ligase (NEB) into pAWY025 vector digested with Ndel and Xbal in buffer CutSmart (NEB) to obtain the backbone for ligation. The ligation is performed according to manufacturer's instructions of $T_4$ ligase.

The resultant cassette is then flanked by two regions of homology towards rapamycin PKS module 9 to result in a disruption through homologous recombination. The disruption is performed according to techniques of *Streptomyces* manipulation know to a person skilled in art and results in ISOM-5870.
Briefly, the plasmid is electroporated Into ET12567: pUZ8002 and selected on 2TY agar medium containing capreomycin (50 pg/mL), kanamycin (25 pg/mL), and chloramphenicol (25 pg/mL). Single colonies are grown overnight in 3 ml 2TY liquid medium containing capreomycin (50 pg/mL), kanamycin (25 pg/mL) and chloramphenicol (25pg/ml). 0.7 ml of this culture is used to inoculate 10 ml liquid medium containing capreomycin (50pg/ml), kanamycin (25pg/ml) and chloramphenicol (25 pg/mL) and grown at 37 C to reach an OD of approximately 0.5. Cells are pelleted at 4000 rpm for 10 minutes and washed twice with 10 ml 2xTY before resuspending in 0.25 mL 2 TY. Spores of *S. rapamycinicus* ISOM-3410 grown on ISP3 for 2-3 weeks are harvested using 20% glycerol and stored at −80° C. (1 plate gives about 1 mL spore stock). For the conjugation approximately 0.3-0.5 mL of these spores are needed for each corjugation.
Spores are unfrozen and pelleted by centrifugation (4000 rpm, 10 minutes) before washing with 2xTY. The spores are then repelleted and resuspended in 0.25 mL 2xTY and heat shocked in a water bath at 50° C. for 10 minutes before cooling immediately on ice. The conjugation is performed by adding 0.25 mL of washed *E. coli* cells to the heat shocked spores, mixing and spreading the mixture onto a R6 plate and transferring to 37° C. The plate is overlaid with 2 mL water containing 15 μL nalidixic acid (stock 50 mghnL) after 2-3 hours and with 2 mL water containing 15 μL capreomycin (stock 100 mg/mL) after an overnight incubation. The single colonies are plated onto MAM medium with a selective capreomycin concentration and 250 pM X-Gluc (5-Bromo-4-chloro-3-indolyl-s-D-glucuronide sodium salt) added as a substrate for GusA. The blue, resistant patches are selected forward, and as an additional step, the strains are plated onto MAM plates and left for 14-21 days to sporulate. Then the spores are harvested in water, filtered through sterile cotton wool, diluted to single colonies and plated on MAM plates with 250 pM X-Gluc. When single colonies are grown, they are selected for blue colour and capreomycin sensitivity. Alternatively, any other means of disrupting the continuity of PKS can be used here, including (but not restricted to) methods based on homologous recombination, or gene editing methods (i.e. CRISPR, ZFN or TALENs). The selected clones are tested for rapamycin producton, and the confirmed non-producers are taken forward.

Then, plasmids pAW317 and pAW302 were generated as described in Example 5B and ISOM-5913 was generated. Spores of S. rmpamycinicus ISOM-5913 are subsequently conjugated with a pKC1139-based plasmid pML007, as described above, to generate a primary integrant into the rapamycin PKS gene. Briefly, the pML007 plasmid is electroporated into ET12567:pUZ8002 and selected on 2TY agar medium containing spectinomycin (50 pg/mL), kanamycin (25 pg/mL), and chloramphenicol (25 pg/mL). Single colonies are grown overnight in 3 ml 2TY liquid medium containing spectinomycin (50 pg/mL), kanamycin (25 pg/mL) and chloramphenicol (25pg/ml). 0.7 ml of this culture is used to inoculate 10 ml liquid medium containing spectinomycin (50pg/ml), kanamycin (25pg/ml) and chloramphenicol (25 pg/mL) and grown at 37 C to reach an OD of approximately 0.5. Cells are pelleted at 4000 rpm for 10 minutes and washed twice with 10 ml 2xTY before resuspending in 0.25 mL 2 TY. Spores of *S. rapamycinicus* ISOM-5803 grown on ISP3 for 2-3 weeks are harvested using 20% glycerol and stored at −80° C. (1 plate gives about 1 mL spore stock). For the conjugation approximately 0.3-0.5 mL of these spores are needed for each conjugation. Spores are unfrozen and pelleted by centrifugation (4000 rpm, 10 minutes) before washing with 2xTY. The spores are then repelleted and resuspended in 0.25 mL 2xTY and heat shocked in a water bath at 50° C. for 10 minutes before cooling immediately on ice. The conjugation is performed by adding 0.25 mL of washed *E. coli* cells to the heat shocked spores, mixing and spreading the mixture onto a R8 plate and transferring to 37° C. The plate is overlaid with 2 mL water containing 15 μL nalidixic acid (stock 50 mg/mL) after 2-3 hours and with 2 mL water containing 15 μL spectinomycin (stock 100 mg/mL) after an overnight incubation.

Plates are incubated at 37C until single exconjugant colonies are visible. Colonies (approxdmately 15-20) are patched to MAM containing spectinomycin and naiidixic acid and reincubated at 37° C. This colony is then repatched to the same media (containing spectinomycin and nalidixic acid) to ensure there was no *E. coli* contamination. Once stabilised approximately 10-15 of the strains are patched to solid ISP3 media lacking antibiotics and incubated at 37C for approximately 3 days before repatching to ISP3 media and growing for a further 3 or 4 days. A final round of subculture at 37° C. on ISP3 is performed before plating to ISP3 and leaving at 28° C. for to allow the strain to sporulate (~10-14 days). Spores are harvested in 20% glycerol and a dilution series prepared in water and spread onto solid MD6 media with increasing concentrations of apramycin before incubating at 28° C. until single colonies are visible. The colonies are patched onto MAM and grown as patches until stabilised. Strains are grown for confirmation in RapV7 seed medium without the antibiotic selection (7 mL) in a Falcon tube (50 mL) plugged with a foam bung and cultured at 28° C. and 300 rpm (2.5 cm throw) for 48 h. MD production media (7 mL) is inoculated with this seed culture (0.35 mL) using a wide-orifice tip and fermented for 3 days at 26° C. and 300 rpm (2.5 cm throw). Among the strains that no longer produced the original compound, strains that produced novel compounds are identified.

Example 23: Use of a Three-Hybrid System to Differentiate Between Binding to Target Protein Domains In this example, we demonstrated the applicability of the three-hybrid system in *Streptomyces* to select between two small molecules: FK508 and rapamycin, which both bind FKBP and additionally bind calcineurin and mTOR respectively (as shown in FIG. 18). Briefly, *Streptomyces lividans* TK24 is transformed with pAW302 and pAW304, as described in Example SB, according to the standard techniques to make ISOM-5572. *Streptomyces lv4dans* TK24 is in parallel transformed with pAW302 and pAW317, as described in Example 7B, according to the standard techniques to make ISOM-5910. For selection of the exconjugants of interest, in both cases the overlays with: 1 mL of water with 60 uL of 50 mg/mL nalidbdc acid, 1 mL of water with 100 uL hygromycin and 1 mL of water with 30 uL of kanamycin, were used. When the single colonies were visible, they were patched onto MAM agar with hygromycin, kanamycin and nalidixic acid. When the strains were stabilised, they were plated on agar plates with additives. Apramycin sulphate was added from 100 mg/mL aqueous solution. FK508 and rapamycin were prepared in methanol solutions and added to 1 uM. The first plate was prepared with FK506 and apramycin. The second plate was prepared with repamycin and apramycin. Apramycin was used as a selective marker, and added to 100 pg/mL On plate with FK506 and apramycin, strain ISOM-5572 was not viable, but strain ISOM-5910 was viable. On plate with FK508 and apramycin, strain ISOM-5910 was not viable, but strain ISOM-5572 was viable.

Example 24: Use of a Three-Hybrid System to Select for Polyketidelnon-Ribosomal Peptides that Bind to A Target Protein Domain (mTOR) from a Library of Cells Producing Polyketides/Non Ribosomal Peptides Plasmids pAW302 and pAW304 were prepared as described in Example 58. ISOM-4174, (previously described as phenotype D from BIOT-4827 (VO2015/004458), deposited at the NCIMB strain coliection as NCIMB 42152), was transformed with pAW302 and pAW304, and the ex-conjugants were overlaid with kanamycin, hygromycin and nalidixic add. 9 isolates underwent analytical fermentation. Briefly, cylindrical agar plugs from a well grown culture were grown in RapV7 seed medium without antibiotic selection (7 mL) in a Falcon tube (50 mL) plugged with a foam bung and cultured at 28° C. and 300 rpm (2.5 cm throw) for 48 h. MD6 production media (7 mL) was inoculated with this seed culture (0.35 mL) using a wide-orifice tip and fermented for 6 days at 28° C. and 300 rpm (2.5 cm throw). 24 hours post inoculation, 50 uL of trans-4-hydroxy-cyclohexanecarboxylic add (hCHCA) feed was added from methanol solution. The analytical samples of the broth were analysed as described in general methods. Isolate 4, which was characterised by 32.5 mg/L production of BC363 (compound 6 in WO2015/004458) was selected for further work and named ISOM-5730.

ISOM-4144, (previously described as phenotype C from BIOT-4827 (WO2015/004458), deposited at the NCIMB strain coliection as NCIMB 42152), was transformed with pAW302 and pAW304, the ex-conjugants were overlaid with kanamydin, hygromydn and nalidbdc acid. 2 isolates underwent analytical fermentation. Briefly, cylindrical agar plugs from a well grown culture were grown in RapV7 seed medium without antibiotic selection (7 mL) in a Falcon tube (50 mL) plugged with a foam bung and cultured at 28° C. and 300 rpm (2.5 cm throw) for 48 h. MD8 production media (7 mL) was inoculated with this seed culture (0.35 mL) using a wide-orifice tip and fermented for 6 days at 26° C. and 300 rpm (2.5 cm throw). 24 hours post inoculation, 50 uL of 46.1 mg/mL hCHCA feed was added from methanol solution. The analytical samples of the broth were analysed as described in general methods. Isolate 1, which was characterised by 84 mg/L production of BC361 (compound 4 in WO2015/004458) was selected for further work and named ISOM-5733.

ISOM-4010, a BC210 producer (Kendrew et al., 2013), was transformed with pAW302 and pAW304, the ex-conjugants were overlaid with kanamycin, hygromycin and nalidixic add. 7 Isolates underwent analytical fermentation. Briefly, cylindrical agar plugs from a well grown agar culture were grown in RapV7 seed medium without antibiotic selection (7 mL) in a Falcon tube (50 mL) plugged with a foam bung and cultured at 28° C. and 300 rpm (2.5 cm throw) for 48 h. MD6 production media (7 mL) Is inoculated with this seed culture (0.35 mL) using a wide-orifice tip and fermented for 6 days at 28° C. and 300 rpm (2.5 cm throw). 24 hours post inoculation, 50 uL of hCHCA feed was added from methanol solution. The analytical samples of the broth were analysed as described in general methods. Isolate 4, which was characterised by 84 mg/L production of BC210 was selected for further work and named ISOM-5736.

ISOM-5730, ISOM-5733 and ISOM-5736 underwent sporulation on MAM plates and the spores were collected in sterile water. Then, the spores were mixed in equivolume proportions, and the one 50 mL MD6 agar plate with 50 pg/mL apramycin sulphate was inoculated with the 600 uL of mixed spore stock. The selection system causes enrichment of the population towards those that produce the most potent mTOR binder, in this example ISOM-5736.

Example 25: Use of a Three-Hybrid System to Select for Polyketide/Non-Ribosomal Peptides that Bind to a Target Protein Domain (Calcineurin) from a Library of Cells Producing Polyketides/Non Ribosomal Peptides In this example, the applicability of the three-hybrid system to select a strain of interest form a library of producers of small molecules is demonstrated. This example also describes a principle of using the three-hybrid selection system to select a producer of a molecule of interest from a phylogenetically diverse population of Streptomycetes.

Briefly, rapamycin-producer Streptomyres rapamycinlcus ISOM-3410 (Kendrew et al., 2013) and the FK506-producer *Streptomyces* tsukubaensls no. 9993 (FermBP-927) (International Patent Organism Depositary, Tsukuba, Japan) are transformed with pAW302 and pAW304, as described in Example 58, according to the standard techniques as described in general methods. For selection of the exconjugants of Interest, in both cases the ex-conjugants are overlaid with: 1 mL of water with 60 uL of 50 mg/mL nalidbdc acid, 1 mL of water with 100 uL hygromycin and 1 mL of water with 30 uL of kanamycin. When the single colonies are visible, they are plated onto MAM agar with hygromycin, kanamycin and nalidbdc acid. When the strains are sporulating, the spores are collected in 20% glycerol and mixed altogether to obtain a mixture of strains. Upon plating on agar production medium plates apramycin, the only surviving strain is *Streptomyces* rapamycinicus ISOM-3410.

*Streptomyces* rapamycdrlcus ISOM-3410 (Kendrew et al., 2013) and *Streptomyces* tsukubaensis no. 9993 (FermBP-927) (International Patent Organism Depositary, Tsukuba, Japan) are transformed with pAW302 and pAW317, as described in Example 78, according to the standard techniques as described in general methods. For selection of the exconjugants of interest, in both cases the ex-conjugants are overlaid with: 1 mL of water with 60 uL of 50 mg/mL naldixic acid, 1 mL of water with 100 uL hygromycin and 1 mL of water with 30 uL of kanamycin. When the single colonies are visible, they are plated onto MAM agar with hygromycin, kanamycin and nalldbdc acid. When the strains are sporulating, the spores are collected in 20% glycerol and mixed altogether to obtain a mixture of strains. Upon Inoculating onto agar production medium with 100 pgMhnL apramycin sulphate, the plate is enriched in *Streptomyces* tsukubaensis no. 9993 (FermBP-927).

This principle is also applicable for a library of natural producers of unknown natural products, that are capable of binding to mTOR and FKBP. In this case the three-hybrid selection systems Is used to select from a library of previously unknown strains, if they are viable when transformed with pAW302 and pAW304 under selection with apramycin sulphate.

This principle is also applicable for a library of natural producers of unknown natural products, that are capable of binding to calcineurin and FKBP. In this case the three-hybrid selection systems i used to select from a library of previously unknown strains, If they are viable when transformed with pAW302 and pAW317 under selection with apramycin sulphate.

Example 26: Generation of an Alternative Intein-Based Three-Hybrid Selection System This example describes the generation and use of an alternative three-hybrid system. This version of the three-hybrid system uses inteln splicing triggered by binding of a polyketide or non-ribosomal peptide exemplified herein by rapamycin.

The sequence of VMA1-Derived Endonuclease from yeast ((Ozawa et al., 2000, 2001)) has been selected for this variant of the three-hybrid selection system. Cassette 1 has been designed to form an in-frame translational fusion of an N-terminal fragment of codon-optimised VDE (residues 1-184 of N-terminus of VDE) with an N-terminal fragment of codon-optimised GFP (1-128 aminoacids) and human FKBP12 (also codon optimised for *Streptomyces*) (SEQ ID NO 201).

The sequences were codon optimised for *Streptomyces* expression using an online tool (Stothard et al., 2000) and the *Streptomyces* coelicolorA3(2) codon usage table (Nakamura et al., 2000). The cassette described above, extended with overhangs for cloning by InFusion cloning has been named cassette 1 (SEQ ID NO 201) and is ordered from a suitable synthetic DNA provider as a double-stranded DNA fragment FRAP has been codon-optimised as above and is fused with the C-terminal fragment of VDE (C-VDE, 389-454 amino acids) and is fused to the C-terminal fragment of GFP (C-GFP; 129-239 amino acids). The cassette described above, extended with overhangs for InFusion cloning has been named cassette 2 (SEQ ID NO 202) and is ordered from a suitable synthetic DNA provider as a double-stranded DNA fragment Two cassettes described as above are ordered from a synthetic DNA provider, and are inserted by InFusion cloning between the Nidel and Xbal sites of plasmid pSMC8 In the case of cassette 1 and pAW022 in the case of cassette 2. Upon delivery, the cassettes are handled according to the synthetic DNA provider's instructions, for example dissolving in 50 uL water. The vectors are prepared by restriction digestion with Ndel and Xbel in CutSmart buffer (NEB) and undergo 1% agarose gel electrophoresis. The fragments are localised on the gel and isolated. The InFusion cloning reaction is set up according to the manufacturer's Instructions and incubated at 50° C. for 15 minutes. Finally, 1 uL of the product is used for transformation of *E. coli* HSTO8 cells, and the clones of interest are identified. Plasmids are isolated from overnight cultures of the identified clones. The resultant plasmids are named pAW403 for cassette 1 and pAW404 for cassette 2. Both plasmids are used to transform ISOM-5032 or an equivalent strain.

Briefly, the *E. coli-Streptomyces* shuttle plasmid Is electroporated into *E. coli* ET12567:pUZ8002 and selected on 2TY agar medium containing appropriate selection antib*i*otic for the incoming marker (e.g. apramycin at 50 pg/mL for pAW403), and ampicillin (25 pg/mL for pAW404), as well as chloramphenicol (25 pg/nL) and kanamycin (25 pg/mL). Single colonies are grown overnight in 5 ml 2TY liquid medium containing appropriate selection antibiotic forthe incoming marker (e.g. apramycmn at (50 pg/mL), kanamycin (25 pg/mL) and chloramphenicol (25pg/ml). 1 ml of this culture is used to inoculate 10 ml liquid medium containing appropriate selection antibiotic for the incoming marker (e.g. apramycin at (50 pg/mL), kanamycin (25pg/ml) and chloramphenicol (25 pg/mL) and grown at 37 C to reach an OD of 0.4-0.6. Cells are pelleted at 4000 rpm for 10 minutes and washed twice with 10 ml 2TY before resuspending in 0.5 mL 2TY. Spores of S. hygrscopicus ISOM-5032 grown on MAM for 2 weeks are harvested using 20% glycerol and stored at −80° C. (1 plate gives about 1 mL spore stock). For the conjugation, approximately 0.5 mL of these spores are needed for each conjugation. Spores are unfrozen and pelleted by centrifugation (4000 rpm, 10 minutes) before washing with 2TY. The spores are then centrifuged again and resuspended in 0.25 mL 2TY and heat shocked in a water bath at 50° C. for 10 minutes before cooling immediately on ice. The conjugation is performed by adding 0.25 mL of washed *E. coli* cells to the heat shocked spores, mixing and spreading the mixture onto a R6 plate and transferring to 37° C. The plate is overlaid with 2 mL water containing 15 µL nalidbdc acid (stock 50 mg/mL) and, subsequently, with 2 mL water containing appropriate selection antibiotic for the incoming marker (e.g. apramycin 15 uL of a 100 mg/mL stock) after an overnight incubation.

Plates are incubated at 28° C. until single exconjugant colonies are visible. Colonies (approximately 10) are patched to MAM containing the appropriate selection antibiotic for the incoming markers and nalidixic acid and reincubated at 28° C. Usually this colony is then repatched to the same media (containing selection for the incoming marker and nalidixic acid) to ensure there is no E. coi contamination before plating to MAM and leaving at 28° C. to allow the strain to sporulate (~10-14 days). The exconjugant strains are tested by PCR to confirm they now contain the incoming genes of interest.

The strains obtained as above are subsequently transformed with a library generated as described in examples 1, 2, 3, 12 and 13, and the selection Is performed using a cell sorter to detect fluorescence of GFP triggered by the rapamycin analogues capable of Interacting with FKBP and mTOR.

REFERENCES

Bernard, P. New ccdB positive-selection cloning vectors with kanamycin or chloramphenicol selectable markers, Gene 1995,162, 159-160.

Smith, G. P. Filamentous fusion phage: Novel expression vectors that display cloned antigens on the virion surface. Science 1985, 228, 1315-1317.

Parmley, S. F.; Smith, G. P. Antibody-selectable filamentous fd phage vectors: Affinity purification of target genes. Gene 1988, 73, 305-318.

Burioni, R.; Plaisant, P.; Delli Carri, V.; Vannini, A.; Spanu, T.; Clementi, M.; Fadda, G.; Varaldo, P. E. An improved phage display vector for antibody repertoire cloning by construction of combinatorial libraries. Res. Virol. 1997, 148, 161-164.

Kuscer et al., 2007 J. Bacterial. July 2007 vol. 189 no. 13 4756-4763 Roles of rapH and rapG in Positive Regulation of Rapamycin Biosynthesis in Streptomyces hygroscopicus.

Andexer et al., 2011 Proc Nati Acad Sci USA. 2011 Mar. 22; 108(12): 4776-4781 Biosynthesis of the immunosuppressants FK506, FKS20, and rapamycln Involves a previously undescribed family of enzymes acting on chorismate.

Lahlou, M 2013 Pharmacology and Pharmacy, 4,17-31. The success of Natural Products in Drug Discovery.

Oliynyk, O et al., 1996 Chem Biol, 3(10):833-9. A hybrid modular polyketide synthase obtained by domain swapping.

Tsukuda, M. et al., Counterselection method based on conditional silencing of antitoxin genes in Escheuichla coli. Journal of Bioscience and Bioengineering, 2015, 120, 591-595.

Del Vecchio et al., 2003 J Ind Microbiol. Biotechnol. 30(8): 489-494 Active-site residue, domain and module swaps in modular polyketide synthases.

Magari et al., 1997 J. Clin. Invest. 100(11): 2865-2872.

Bashiruddin & Suga, 2015 Curr. Op. Chem. Biol. 24:131-138 Construction and screening of vast libraries of natural product-like macrocyclic peptides using in vitro display technologies.

Wilm et al., 2011 Molecular Systems Biology 7:539 Fast, scalable generation of high-quality protein multiple sequence alignments using Clustal Omega.

Dunn and Khosla, 2013 J R Soc Interface 10(85): 20130297 Engineering the acyitransferase substrate specificity of assembly line polyketide synthases.

Weissman, 2016 Nat Prod Reports Advance article DOI: 10.1039/C5NP00109A.

Adams A., Gottschling D. E., Kaiser C. A., Steams T. Methods in Yeast Genetics: A Cold Spring Harbor Laboratory Course Manual. Cold Spring Harbor, N.Y.: Cold Spring Harbor Laboratory Press; 1997.

Shao and Zhao (2013), Methods Mol. Biol. 1073:85-106. Construction and engineering of large biochemical pathways via DNA assembler.

Weber, T. et al. (2015), Nucleic Acids Research 43: W237-W243. antiSMASH 3.0-a comprehensive resource for the genome mining of biosynthetic gene clusters.

Blin et al., 2013 Nucleic Acid Res 41:W204-12 antiSMASH 2.0—a versatile platform for genome mining of secondary metabolite producers.

You et al., 2013 JACS 135(20):7406-7409 Stereochemistry of Reductions Catalyzed by Methyl-Epimerizing Ketoreductase Domains of Polyketide Syntheses.

Chan et al., 2009 Nat. Prod. Rep. 26:90-114 Biosynthesis of polyketide synthase extender units Dubeau et al., 2009 Appl Environ Microbiol 75(4):1211-1214 Cytosine Deaminase as a Negative Selection Marker for Gene Disruption and Replacement in the Genus Streptomyces and Other Actinobacteria.

Fayed et al., 2015 Appl. Environ. Microbiol. December 2015; 81:24 8402-8413 Multiplexed Integrating Plasmids for Engineering of the Erythromycin Gene Cluster for Expression in Streptomyces spp. and Combinatorial Biosynthesis.

Shaner et al., 2004 Nat Biotechnol 22(12):1567-72 Improved monomeric red, orange and yellow fluorescent proteins derived from Discosoma sp. red fluorescent protein.

Sun et al., 1999 Microbiol. 145:2221-2227 Green fluorescent protein as a reporter for spatial and temporal gene expression in Streptomyces coelicolor A3(2).

Clemons et al., 2002 Chem Biol 9(1):49-61 Synthesis of calcineurin-resistant derivatives of FK506 and selection of compensatory receptors.

Rui and Zhang, 2016 Curr. Topics in Med. Chem. 16: 1755-1762 Engineering biosynthesis of non-ribosomal peptides and polyketides by directed evolution.

Henning et al., 2003 Conditional Protein Splicing: A New Tool to Control Protein Structure and Function in Vitro and in Vivo J. AM. CHEM. SOC. 2003, 125, 10561-10569

Althoff et al., 2002 A bacterial small-molecule three-hybrid system. Angew Chem Int Ed Engl. Jul 2;41(13): 2327-30.

Kendrew et al., 2013, Recombinant strains for the enhanced production of bioengineered rapalogs. Metabolic Engineering 15 (January 2013):167-173.

Fu et al., 1999, A microfabricated fluorescence-activated cell sorter. Nat Biotechnol. 1999 November; 17(11):1109-11.

Mootz et al., 2002, Protein splicing triggered by a small molecule. JACS, 124, 9044-9045.

Mootz et al., 2003, Conditional protein splicing: a new tool to control protein structure and function in vitro and in vivo. JACS, 125, 10561-10569.

Licitra et al., 1996, A three-hybrid system for detecting small ligand-protein receptor interactions. 93, 12817-12821, November 1996

Bierman et al., 1992, Plasmid cloning vectors for the conjugal transfer of DNA from Escherichia coil to Streptomyces app., Gene, 1992, Jul 1;116(1):43-9.

Ranganathan et al., 1999, Knowledge-based design of bimodular and trimodular polyketide synthases based on domain and module swaps: a route to simple statin analogues. Chemistry & Biology, 8, 10, October 1999, Pages 731-741

Marinec et al., 2009, FK506-*binding protein (FKBP) partitions a modified HIV protease Inhibitor Into blood cells and prolongs its lifetime in vivo*. Feb. 3, 2009 vol. 106 no. 5

Sambrook et al., 1989, Molecular cloning: a laboratory manual. No.Ed. 2 pp. XXXVIII+1546 pp.

Zhang et al., 1999, Yeast three-hybrid system to detect and analyze Interactions between RNA and protein. *Methods in Enzymology.* 306,1999,93-113Rückert et al., 2015, Complete genome sequence of *Streptomyces lividans* TK24. *J Biotechnol.* 2015 Apr. 10; 199:21-2

Rowe et al., 1998, Construction of new vectors for high-level expression in actinomycetes, *Gene,* 216,215-223

Ozawa et al., 2000. A fluorescent Indicator for detecting protein-protein interactions in vivo based on protein splicing. *Anal. Chem.* 72, 5151-5157.

Ozawa, et al., 2001. Protein splicing-based reconstitution of split green fluorescent protein for monitoring protein-protein interactions in bacteria: improved sensitivity and reduced screening time. *Anal. Chem.* 73, 5866-5874.

Nakamura et al., 2000, *Codon usage tabulated from the international DNA sequence databases: status for the year 2000.* Nucd. Acids Res. 28, 292.

Stothard P (2000) The Sequence Manipulation Suite: JavaScript programs for analyzing and formatting protein and DNA sequences. *Biotechniques* 28:1102-1104.

Liu, X. Q.; Yang, J. (2004) Prp8 intein in fungal pathogens: target for potential antifungal drugs. *FEBS Lett* 572(1-3): 46-50.

Butler, M. I.; Poulter, R. T. (2005) The PRP8 inteins in *Cryptococcus* are a source of phylogenetic and epidemiological information. *Fungal Genet Biol* 42(5): 452-63.

Pietrokovski, S. (1998) Modular organization of inteins and C-terminal autocatalytic domains. *Protein Sci* 7(1): 64-71. Amitai, G.; Dassa, B.; Pietrokovski, S. (2004) Protein splicing of intains with atypical glutamine and aspartate C-terminal residues. *J Biol Chem* 279(5): 3121-31.

Jakob, N. J.; Muller, K.; Bahr, U.; Darai, G. (2001) Analysis of the first complete DNA sequence of an invertebrate iridovirus: coding strategy of the genome of *Chilo* Iridescent virus. Virology 286(1): 182-96.

Huang, C.; Wang, S.; Chen, L.; Lemieux, C.; Otis, C.; Turmel, M.; Liu, X. Q. (1994) The *Chlamydomonas* chloroplast cIpP gene contains translated large insertion sequences and is essential for cell growth. *Mol Gen Genet* 244(2): 151-9.

Perder, F. B.; Olsen, G. J.; Adam, E. (1997) Compilation and analysis of intein sequences. *Nucleic Acids Res* 25(6): 1087-93.

Dalgaard, J. Z.; Moser, M. J.; Hughey, R.; MIan, I. S. (1997) Statistical modeling, phylogenetic analysis and structure prediction of a protein splicing domain common to inteins and hedgehog proteins. *J Comput Biol* 4(2): 193-214.

Raoult, D.; Audic, S.; Robert, C.; Abergel, C.; Renesto, P.; Ogata, H.; La Scola, B.; Suzan, M.;

Claverie, J. M. (2004) The 1.2-megabase genome sequence of Mimivirus. *Science* 306(5700): 1344-50.

Ogata, H.; Raoult, D.; Claverie, J. M. (2005) A new example of viral intein in Mimivirus. *Virol J* 2: 8.

Amitai, 2002, *Distribution and function of new bacterial Intein-like protein domains*, Volume 47, Issue 1January 2003 Pages 61-73.

Topilina et al, 2015, *PNAS* Aug. 18, 2015 vol. 112 no. 33 10348-10353.

Perler, F. B. (2002). InBase, the intein Database. *Nucleic Acids Res.* 30, 383-384.

The application, of which this description and claims form part, may be used as a basis for priority in respect of any subsequent application. The claims of such subsequent application may be directed to any feature or combination of features described herein. They may take the form of product, composition, process, or use claims and may include, by way of example and without limitation, the following claims.

SEQUENCE LISTING (349 sequences)

SEQ ID NO: 1 - DNA, 908 bp, Artificial Sequence
  Primer
ctctagagaattccatatgagggaagatcagcttctcgacgcattgcgcaagtcggtcaaggagaacgcgcggctccgcaaggcgaacacgtcgttgcgggcagccatggacgagccgttggcgcgaagagcatgctcttcgggcctgtgggaggacgccagcggcctgaccgcgaagctgaccggtaccgaccatgaccggatccggcgcagcgggctgcgaaccatcaccgccgagcgcgggatgcggctgttcgacatcgcctcacgtcagggtgaaccggttctggtggccacgccgatggagccggtgcgggaggtcgaggttccggcattgctgcgtttgttgcaccgcccggttgcccggcgggccgcctccaccggtgattcgtcggcgcagtggctggtcggcttggcgccggaggagcgggcgaaggcactgctgaaggtggtgcgtgacagcgccgcgacggttctgggacatgccgacgcccgcagtattccggcgaccggtgcgttcaaggatttgggtgtggactcgctgaccgcggtggagctgcgcaacagtctgacgaaggccacgggcctgcggctgcccgccacaatggtgttcgactacccgaccccggcagacctggccgcccggctgggcgacctcatgaacccgagggttcagtcgacgaccctgctcgccgagatcgatcgcatagaaaagatgttcacgtccgtgaccttcgacgatcgacaggcatccgcgatcaaggatcggctgtcgtcggttctgaataaatggcagcggatttcgagccccgaagaggtttccactaccgccctctcgagtgcgagtgccagcgaaatccttgacttcatcgatcgggagttcggtgatcccacggcctgaatctaga

SEQ ID NO: 2 - DNA, 3514 bp, Artificial Sequence
  Primer
gctcttcggacgagccgttggcgattgtgggtatggcgtgccgtctgccgggtggggtgtcgtccccggaggatctgtggcgccttgtcgagtcgggtacggacgcgatttccggattccccgccgaccgtggctgggacgtcgagaacctgtacgaccctgatccggaggcggcaggcaagtcgtactgcgtgcagggcggcttcctggactccgcaggcggtttcgacgcctcgttcttcgggatcagtcctcgtgaggcgttggcgatggatccgcagcagcggctggtcctggaggcgtcctgggaagcgttcgaacgggccgggatcgaacccggttccctccgcggtagcgacaccggtgttttcatgggtgcgtaccccggtggctacggcgttggtgccgacctcggcggcttcggggcaactgccggtgcggtgagtgtcctgtcgggtcgggtgtcgtatttcttcggcctcgaggggccggctgtcacggtggacacggcgtgttcgtcgtcgttggtggcgttgcatcaggcggcgtatgccctgcggcagggtgagtgttcgctggccctggtcggtggtgtcactgtgatggccacgccgcaaagtttcgtggagttctcgcggcagcgtggcctggcctccgacggccggtgcaaggcgttcgcggatagtgcggacggcacgggctgggctgaaggcgccggtgtgctgctggtagagcggctgtccgatgcccagcgcaagggccaccaggtgcttgcggtggtgcggggatcggcggtcaatcaggacggtgcgtcgaacggcctgtccgcgccgaacggtccttcgcagcagcgggtgatccgggcggctctcagcaatgcgggtctgagtacggctgaggtggatgtggtcgaggcgcacggcacgggtacgacgctgggtgacccgatcgaggcccaggcgctgctggcgacctatggccaggatcgtgagcagccgttgctgttgggttcggtgaagtcgaatctgggtcatacgcaggccgctgcgggtgtgtctggtgtcatcaagatggtgatggcgctgcagcacgtcttggtgccgcgtacgttgcatgtggatgagccgtcgcggcatgtggactggacggatggcgcggttgcgctggtgacggagaaccagccgtggccggatatgggtcggcctcgccgggcgggtgtgtcgtccttcgggatcagtggcaccaacgcccacgtcatcctggaaagcgcaccccccacgcaggctgtggacgatgtgccgcctgcggaggcgccggtggtggcgtcggagttggtgccgctggtgatttcggcgaggacgttgccagctctggtcgagtacgaggaccggctgcgtgcgtatttggcggcgtcgcctggggtggacgtgcggggtgtggcgtcaacgctggcggtgacgcgttcggtgttcgagcaccgggcggtgctccttggagatgacaccgttaccgggaccacggtgtctgatccgcgggtggtgttcgtcttcccgggtcaggggtcgcagcgtgctggtatgggtgaggaactggccgccgcgttccccgtcttcgcgcggatccatcagcaggtctggggcctgctggacgtgcccgatctggaggtgaacgaaaccggctatgcccagccggccctgttcgctttgcaggtcgccctgttcgggttgctggaatcgtggggtgtacggccggacgcggtggtcggtcactctgtcggtgagctcgccgccggatacgtctccgggttgtggtcgctggaggatgcctgcacgctggtgtcggcgcgggcccgcctcatgcaggccctgcccccgggtggggtgatggtcgccgtcccggtgtccgaagatgaggcccgggccgtgctgggtgagggtgtggagatcgccgcggtcaacggcccgtcgtcggtggttctctccggcgatgaaaccgcagtactgcaggccgcagcagccttgggcaagtcaacacgtctggcaaccagccatgccttccactccgcccgcatggaacccatgctggaggagttccggacggtcgccgaacgcctcacctaccaaacaccccgcctcgccatggccgctggtgatcgggtgacgacggctgagtactgggtgcggcaggtccgggacacggtccggttcggcgagcaggtcgcctcgtacgaggacgcggtgttcatcgagctgggtgccgaccggtcgctggcccgcctggtcgacggtgtcgcgatgctgcacaccgaccacgaggcacaggccgcgatcagtgccctggcccacctgtatgtcaacggcgtcaccgtcgactggaccgcgcttctgggcgatgctccggcaacacgggtgctggaccttccgacatacgccttccagcaccagcggtattggcttgagggtgcggaccgggcggccgcgggcggtcatccgctgctcgggccggcggtagggctggccgaggccagtggagtgctgtttacctcgcaagtttcccggagcggtgatctgtggttgcaggaccagacggtcttgcccgcgacggcgttcgccgagatggcgctggcagcggcggacgaaaccggctgcggcctggtcgaggaactcaccgtggaagccttgctgctgcttcctgacgatggcgccgtccaggtacagacctgggtgagcgaacccgacgatgccggccgccgccagctcagtatccacgcccgttacagcgacgacgagctctggacacgcctggccaccgcgaccctggccaccaccaccggtagggtgtccggttggcaggccggcgaggcgtggccgccggccggtgcggtcccggtcgaggcccgagtaccgtcactgcgcggggtgtggcgccgtggcagcgaagtgttcgccgaggtcgccctggacgacacccacgacgccaccaggtttttgcttcatcccggcctgatgactgccgccttcgccgccgtaggcgaggagactcccgccgcgtggcagggcttgaccctgcacgcccgcaacgctgccgagctgcgcgtccgcctcacctcacaggatgacgaaaccctgtcggtagaggccgtcgacagcacagggcttcctgtcctgaccgcccgctccctcgcgctggacgccgttcccgtcaacgaaccggccaccagtgccaccgacctgctcaccctgacctgggcaggaatcgccacccgccagcagcagaccggtctgacggtgggtgcgtttgaagacctggcggcggacggcgatgcgccggtgcccgatgtcgtggtgttcaccgcgctccccggcaacgacgacccgctggcacagactcgcatactgaccgcgcaggttctgcggacagtccaggagtggattggcggggaacgcttcagcgacagcacgctggtggtgcggaccggtactggtttggccgcggcagcggtgtcgggaagagc

SEQ ID NO: 3 - DNA, 2446 bp, Artificial Sequence
  Synthetic
gctcttccgcggcagcggtgtcggggttgatgcgctcggcccagtccgaacaccccggccggttcatcctggtggaaagtgatgacgacgccctcactccggaccagctggccgcgactgtcggattggacgagccgcggctgcggatcagcgacggccggtacgaagtaccacggctgacccgcgcacatgccgatgagcctgagcctgaaagggcgtgggatccggatggcacggtcctgatcacgggcggttccggcgttctggcggggatcgtcgcccggcacctggtggccgaacgtggtgtgcgtcatctcctgctgctgtctcgcggcactccggaccgggcgctgctcagcgagttggccgagttgggtgccgcggtggacacagcggcctgtgacgtgtcggatcgtgcagagctggcgcgagtgttggcgcgtgtgtcgccggagcacccgttgacggcggtgattcataccgcgggcgtggtggatgacggtgtcgtggagtccctgagcgcgcagcggctggaaaccgtattccggcccaaggccgatggtgcttggcatttgcacgagctcacccgggacgccgacctggcggcgttcgtcatgtattcctcggctgccggtgtcatggccggtgcgggtcagggtaactacgcggcggcaaacgcgttcctggacgcgctcgccgaagaacgccgagccgagggcctgcccgcactcgcggtggcctggggcctctgggaggacgccagcggcctgaccgcgcaactgaccgacacggaccgtgaccggatccggcgcggtggcctgcgggccatctccgccgagcacgggatgcggctgttcgacaacgcgtcacgccacagtgaaccggttctggtggccgcgccgatggagccggtacgggacgcggaagtcccggcattgctgcggtcgttgcatcgtccgaacgtccggcgtgccgctctcgccggtggagcgcagtggctggcagccctggcgccggaggaggtacgcgtgtcgtcccggctggcgccggtggagcgggagaaggcgctgctgaagctggtgtgtgatggcgccgcgacggttctgggacatgccgacgccagcacgattccggcgaccgcggcgttcaaggatctgggcatcgattcgctgaccgcggtggaactgcggaacagcctgacgaaggccacggggctgcggttgcccgccacgctggtgttcgactaccccaccccgacggccttggcagcccggctgggggagtggttcgtcggtgaaactcctgttccggtgcgtacgtcggtgtcggtggtggcgcaggacgagccgttggcgattgtcggcatggcgtgtcgcttgccgggtggggtgtcgtcgcctgaggatctgtggcgtcttctggagtcgggtacggacgcggtgtccggattccccaccgatcgtggctgggatgtggagaatctgttcggccccgcagctggcgactcctatcgcttgcagggtggtttcctggatgccgcggctggtttcgatgcctcgttcttcgggatcagtccgcgtgaggcgttggcgatggatccgcagcagcggttggtgctggaggtgtcctgggaggcgtttgagcgggccgggatcgagcccggttccgtacgcggaactgacaccggggttttcatgggtgcgtaccccggtggctacggcatcggtgccgacctcggcggcttcggcgccaccgcgagcgcggtcagtgtcctgtccggccgggtgtcgtacttcttcggcctcgaaggccctgccatcacggtggacacggcgtgttcgtcgtcgttggtggcgttgcaccaggcggggtatgccctgcggcagggtgagtgttcgctggccctggtcggtggtgtcaccgtgatggccacgccgcagactttcgtggagttcgctcgtcagggtggcctggccggtgacggtcgcagtaaggcgttcgcggacagtgcggacggcgccggcttctccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatggtgatggcgctgcagcgcggtttcgtgccgcgtacgttgcatggaagagc

SEQ ID NO: 4 - DNA, 2656 bp, Artificial Sequence
  Synthetic
gctcttcgccgcgtacgttgcatgtggatgagccgtcgcggcatgtggactggtcggcgggcgcggttgcgctggtgacggagaaccagccgtggccggatatgggccgagcgcgccgggcaggcgtgtcgtccttcgggatcagtggcaccaacgcccacgtcatcctggaaagcgcaccccccactcagcctgcggacaacgcggtgatcgagcgggcaccggagtggctgccgatggtgatttcggccaggacccagtcggctttgactgagcacgagggccggttgcgtgcgtatctggcggcgtcgcccggggtggatatgcgggctgtggcatcgacgctggcgatcacacggtcggtgttcgagcaccgggccgtgctgctgggagatgacaccgtcaccggtaccgcggcgaccgatccgcgggtggtgttcgtcttcccgggtcaggggtcgcagcgtgctggtatgggtgaggaactggccgccgcgttccccgtcttcgcgcggatccatcagcaggtctgggacctgctcgatgtgcccgatctggaggtgaacgaaaccgggtatgcccagccggccctgttcgctttgcaggtcgctctgttcgggttgctggaatcgtggggtgtacggccggatgcggtggtcggtcactctgtcggtgagctcgccgccggatacgtctccgggttgtggtcgttggaggatgcctgcactttggtgtcggcgcgggctcgtctgatgcaggctctgcctgcgggtggggtgatggtcgctgtcccggtgtcggaggatgaggcccgggccgtgctgggtgagggtgtggagatcgccgcggtcaacgggccgtcgtcggtggttctctccggtgatgaggccgccgtgctgcaggccgcggaggggctggggaagtggacgcggctggcgaccagccacgcgttccattccgcccgtatggagccgatgctggaggagttccgggcggtcgccgaaggcctgacctaccggacgccgcaagtctccatggccgctggtgatcagttgaccaccactgagtactgggtgcggcaggtccgggacacggtccggttcggcgagcaggtcgcctcgtacgaggacgccgtgttcgtcgagctgggtgccgaccggtcactggcccgcctggtcgacggcgtcgcgatgctgcacggcgaccacgaggcgcaggccgctgtcagtgccctggcccacctgtacgtcaacggcgtcaccgtcgactggcccgcgctcctgggcgatgctccggcaacacgggtgctggaccttccgacgtacgccttccagcaccagcgctactggctcgagggcacggaccggatggccgcgggcggccatccgctgctgggtgaggcggtggcggttcccggctcggatggtgtgctgttgaccgggcgggtgtcgttggccacgcacccgtggctggctgatcacgcggtgcggggcagtgtgctgctgcccggtaccgggtttgtggagctggtcgtccgcgccgccgacgaggtcggttgtgacgtcatcgacgagctggtgatcgagacgccgctcctgctgccgcagaccggaggcgtgcaactgtccgtcgcggtcgccgagtccgatgattccggacgccgggcggtgacggtcttctcccgggcggacaacgtcgatacctggacgcggcacgccacggtcacggtcagcaactctgatacgaccctctcgctgccagacctcagtgcgtggccaccagcccaggcccagccggtgaacgtggccgacttctacgatcagttgaccgtggtggcctacgagtacggtcccgcgtttcaggggctgcaggccgcgtggcgtgacggcgacaccgtccacgccgaggtcgccctcgccgaggagcaagcgcaggacgcggcccgaaacgccgtgcatcccgcgttgctggatgctgccctgcacgccgggatcctgaacacgcccgacaccgagcagggcgtgcggttgccgttctcctggaaccaggttcaggtccacgcggtcggctcggcgatgttgcgcgtcgccgtgacacaggcggcggacggctggagtgtgcgggtcgctgatgacaccggccggccggtggccaccatcggctccctcgtgactcggccggtgacggccgacacactcggctccaccaccgacgacctgctcgccctgacgtggacggagatcccggcccctcaggagacgagcctgaccataggccgcttcgaagacctggcggacgccgatgtgccggtgcccgaggtggtggtcttcaccgcacgccccgacagtagcgagaacccgctggcccagactcgtacgctgaccgcccaggtcctgcagaagatccaggcgtggctggccgaggaacgcttcaccgacagcacactgattgtgcggatcggcactggcttggcggctgccgcggtgtcgggtctgatgcggtcgggccagtcggaacatccgggccggtttgtcctggtggaaagcgacgacgacaccctcgcccccgaccagctggcggcgaccgtcgaattggatgagccgcggctgcggatcagcgacggccggttcgaagtgccacgactgacccgaagagc

SEQ ID NO: 5 - DNA, 3514 bp, Artificial Sequence
  Synthetic
gctcttcagtgccacgactgacccgtacgcatgccgctgaacccgagtcagaaaaggtgtgggatccggatggcacggtcctgatcaccggtggttcgggtgtgctggcggggatcgccgcccggcacttggtggccgagcgtggcgtgcgtcatctgctgctgctgtcccgcagcgcaccggacggggcactgatcagcgagcttggcgaactgggcgcccaggtggccacagcggtttgcgacgtatcggatcgccctgggttggtgcgggtgctggcggacgtgtcaccggagcatcccctgacggcggtgattcataccgcgggtgtggtggacgacggtgtggtggagtccctgaccgcgcagcgactggacacggtactgcggcccaaggccgacggtgcctggcacctccacgagctcacccgtgacgccgacctggccgcgttcgtcatgtactcctcggccgccggtgtattcggtagcgcggggcaaggcaactatgcggtggcgaacgcgttcctggacgctctcgcagagcaacgtcgtgccgagggcctgcccgcactcgcactcgcctggggcctctgggagggcaccagcggcctgaccgccaatctgaccgatacagaccatgaccggatccggcgcagcggcatgcgggccatctccgccgagcatggaatgcggctgttcgacggcgcgtcacgccgcagggacccggttctggtggccgcggcgatggagccggtacgggaagccgaagtccctgcgatgctccggtcgttgcaccgccctgtcgcccggcgggcggcctccggtggtgcggtgcggtgcctggccgctctggcgccggaggagcgggcgaaggcactggtgaaggtggtgtgtgacagtgccgcgacggttctgggacacgccgacgtcgacagtattccggtgaccgccgcgttcagggatctgggcgtggattcgctgacggcggtggaactacggaacagcctgacgaaggccacgggactgcggctgcccgccacgttggtgttcgactacccgaccccaggtgccctggccgcccggttggaggagctgttcaccggcgagaatcctgttcaggtacgcacgccggtgtcggcggtggggcaggacgagccgttggcgatcgtgggcatggcctgccgcctgcctggtggggtgtcgtcgcctgaggatctgtggcgccttgtggaatcgggtacggatgcgatttccggtttccccaccgaccgtggctgggacgtggagaacctgttcgactcggatccggatgcggccgggaagtcgtactgcgtagagggtggcttcctggcgaccgctgccaacttcgatgcctcgttcttcgggatcagtccgcgtgaggcgttggcgatggatccgcagcagcggctggtgctggaggtgtcctgggaggcgttcgagcgggctgggatcgagcccggttccgtacgcggcagcgacaccggcgtcttcatgggcgctttcccgggcggttacggcatcggcgcagacctcgaaggttatggtgcgaccgctggcctcaacgtgctgtccggccggctgtcgtacttcttcggtcttgaggggccggccgtcacggtggacacggcgtgttcctcgtcgctggtcgccctgcaccaagcggggtatgccctgcgacagggtgagtgctcgctggccctgatcggcggtgtgaccgtgatggccacaccacataccttcgtggagttctcccggcagcgtggcctggcatccgatggccggtgcaaggcgttcgccgacagcgcggacggcacgggatggtctgagggagtcggcgtcctgctggtcgagcgcctgtcagacgctcaggccaagggccaccaggtattggcagtggtccgcagctcggcggtcaaccaggacggcgcgtcgaacggcctgtccgcgccgaatggcccctcgcaacagcgggtgatccggcaggcgctggccaacgcgggcctgaccacggccgaggtggatgtggtcgaggcccacggcacgggtacgacgttgggtgacccgatcgaggcccaggcggtgatcgcgacctacggtcaggatcgtgaccagcctgtgctgctgggttcggtgaagtcgaacgtcggtcatacgcaggctgccgcgggtgtgtcgggtgtcatcaagatggtgatggcgctgcagcacggtctggtgccgcgtacgttgcatgtggatgagccgtcgcggcatgtggactggacggatggcgcggttgagctggtgacggagaaccagtcctggcccgaagccggtcggccgcgccgggcaggcgtgtcgtccttcggagtcagtggcactaatgcccacgtcatcctggagagcgcaccccccacgcaggccgtggacgatgtgcggcctgcggatgcgccggtggtggcgtcggtgatggcctcggagttggtgccgttggtgatttcggccaagacgcagtcggcactggctgagtacgagggccggttgcgtgcgtatctggcggcgtcgcccggggtggatatgcgggctgtggcatcgacgctggcgatgacacggtcggtgttcgagcaccgtgcggtgatcgtgggtgatgacactgttagtgggaccgcggcgaccgatccgcgggtggtgttcgtcttcccggggcaggggtcgcagcgtgctggtatgggtgcggaactggccgccgcgttccccgtcttcgcgcggatccatcagcaggtctgggacctgctcgatgtgcccgatctggaggtgaatgagacgggttacgcccagccggctttgttcgctttgcaggtcgctctgttcgggttgctggaatcgtggggtgtacggccggacgcggtgatcggccattcggtgggtgagcttgcggctgcgtacgtgtccgggttgtggtcgttggaggatgcctgcactttggtgtcggcgcgggctcgtctgatgcaggctctgcctgcgggtggggtgatggtcgctgtcccggtgtcggaggatgaggctcgggccgtgctgggtgagggtgtggagatcgccgcggtcaacggcccgtcgtcggtggttctctccggtgatgaggccgctgtgctgcaggccgcggaggggctggggaagtggacgcggctggcgaccagtcacgcgttccattccgcccgtatggagccgatgctggaggagttccgggcggtcgctcaaggcctgacctatcacgcacctggtgtcgtgatggccgctggtgatcgggtgatgacggctgagtattgggtgcggcaggtccgggatacggtccggttcggcgagcaggtcgcctcatacgaggacgccgtgttcgtcgagctgggtgccgaccggtcactggcccgcctggtcgacggcgtcgcgatgctgcacggcgaccacgaaacccaggccgcgatcggcgccctggcccacctgtatgtcaacggaagagc

SEQ ID NO: 6 - DNA, 3514 bp, Artificial Sequence
  Synthetic
gctcttcccacctgtatgtcaacggcgtcaccgtcgactggaccgcgctgctgggtgatgtcccggtaacccgggtgctggatcttccgacgtacgccttccagcagcagcggtattgggctgaggtcggccggtctgccgatgtgtcgggggcgggtctggatgcggtggggcatccgttgctgggtgcggtggtggcgttgccgggttcggatggtgtgctgttgaccgggcgggtgtcgttggccacgcatgcgtggctggctgatcacgcggtgcggggcagtgtgctgctgcccggtaccgggtttgtggagctggttgtccgcgcggctgatgaggtgggctgcgacgtcgttgacgagctgatcgtcgaagccccgcttctgctgccgcagaccggcggtgtgcaggtttcggtatcggttggtgaggctgacgagtccggacaccgggtggtgacgatcttctcccgggcggacaacgccgacacctgggtccggcacgtttccgccgtgatcagtacctctgactcgacggtgtcgctgtcggagtttgcctcgtggccaccagctcaggcacagccggtggacgtgacgggcttctacgacccgctgatggcagaagggtacgagtacggtcccgcgttccagggtttgcaggccgcgtggcgttatggggacactgtcttcgccgaggttgctctggctgaggagcaggtccgggaggcggcgcgatatccctccgtgcatccggctctactggatgcggctctgcatgcctgcacccttgaatgcgccgatgccgaggtgggtgtggggctgccgttctcctgggacggtgttcgggtccatgctggtggttcggccatgttgcgtgtcgcggtgacgcaggcggcggatggctggagtgtgcgggtcgctgatgagatcggtcggccggtggctaacgtgggttcgctcgtgacgcgcccggtgacggccgacgcgctcggttccgctgccgatgacctgctcgccttgacctgggcggagatcccggcccctgaggggaccggactgacggtcggccggttcgaggagctggtgtcggacggcgatgtgccggtacccgaggtggcggtcttcaccgcactccccgacaacgacgacgacccgctggagcaaacacgaaagctgaccggtcaggtcctccaggcagttcaggagtggcttggcggggagcgcttcagcgacagcacgctggtggtgcggaccggtactggtttggccgctgctggggtgtcggggttgatgcggtcggcccagtccgaacaccccggccggttcgtcctggtcgagagtgatgacgatgccctcgctctggatcagttggcggcggcggtcgggttggatgagccgcgcctgcggatcagcgacggccgcttcgaagcgccacgactgacccgtacgcatgccgctgaacccgagtcagagaaggtgtgggatccggatggcacggttctgatcaccggtggttcgggtgtgctggcggggatcgccgtccggcacctggtgaccgaacgcggcgtgcgtcatctccttctgctgtcccgcagcgccccggacgaggcactgatcaaccaactcggcgaactgggggcccgggtcgagacagcggcctgtgacgtgtccgatcgtgccgcgctggcccaggtgctggcgggtgtgtcaccggagcatcccctgacggccgtgattcacaccgcgggcgtactcgatgacggtgtggtggagtccctgaccgcgcagcggctggacgcggtgttgcggcccaaggccgacggtgcgtggaacctgcacgagctcacccgggatgccgacctggcggcgttcgtcatgtattcctccgccgctggtgtgctcggcagtgggggacagggcaactacgcggcggccaatgcgttcctggacgcgctggctgagcagcgtcacgctgagggtctgcccgcgctggcggtggcctggggcctgtgggaggacgccagtggcctgaccgcgcaactgaccgacacggaccgtgaccggatccggcgcggtggcctgcgggccatctccgccgagcacgggatggggctgttcgacagcgcgtcacgccacagtgaaccggttctggtggccgcgccgatggagccggtacgggacgcggaagtcccggcattgctgcggtcgttgcaccgcccggtcgctcggcgggccgctgccgccggtggagcgcggtggctggccgcactggctccggccgagcgggagaaggcactgctgaagctggtgtctgacggcgccgcgacggttctgggacacgccgacaccagcacgattccggcaaccacggcgttcaaggatctgggcatcgattcgctgaccgcggtggaactgcgcaacagcctggcgaaggccacggagctgcggctgcccgccacgctggtgttcgactaccccaccccgacggccctggctgcccggttggacgagttgttcaccggcgagaaccccgctccggtgcgcgggccagtgtcggcggtggcgcaggacgagccgctggcgatcgtgggaatggcctgccgcctacccggtggagtctcgtcgccggaggatctgtggcgcttggtcgagtccggtacggacgcgatttccggcttcccaaccgaccgcggctgggacgtcgagaacctgtacgatccggacccggacgcgcccgggaagtcctacagcgtgcagggcggcttcctggatgccgcggccggtttcgacgcctcgttcttcgggatcagtccgcgtgaggcgttggcgatggatccgcagcagcggttgatgcttgaggtgtcctgggaggcgttcgagcgggccgggatcgagcccggttccgtacgcggcagcgacaccggcgtcttcataggtgcttaccccggtggctacggcatcggtgccgacctcggcggcttcgggacaactgctggtgcggcgagtgtgttgtcgggccgggtgtcgtacttcttcggtctggaaggtcccgcgttcacggtggacacggcgtgttcgtcgtcgctggtggcgttgcatcaggcggggtatgccctgcgacagggtgagtgttcgctggccctggtcggcggcgtgaccgtgatgcccacgccgcagactttcgtggagttctcgcggcagcgaggcttgtcagccgatggccggtgcaaggcgttcgctgacgccgcggacggcacggggtgggctgagggcgtcggcgtcctattggtggagcgtttgtcggatgctcaggccaacggtcaccagatattggcggtggtccgtagctcggcggtgaaccaggacggtgcgtcgaacggcctgtccgcgccgaacggtccttcgcagcagcgggtgatccgggccgctctcagcaacgccggcctggcgccgcacgaggtggatgtggtcgaggcgcacggcacgggtacgacgctgggtgaccgaagagc

SEQ ID NO: 7 - DNA, 3514 bp, Artificial Sequence
  Synthetic
gctcttctacgacgctgggtgacccgatcgaggcccaggcggtgatcgctacttacggccagggccgcggggagccgctgctgctgggatcgctgaagtcgaacgtcggccatacccaggctgccgcgggtgtgtcgggtgtcatcaagatggtgatggccctgcagcacagcatggtgccgcgcacgttgcatgtggatgagccgtcgcggcatgtggactggtcggcgggtgcggtcgagctggtggcggagaaccagccgtggccggagacgggccgaccccgtcgggcgggtgtgtcgtcgttcgggatcagtggcactaacgcccacgtcatccttgagagtgcaccggcacagtctgtgggcgacacggctggctctacacccgtactggtttcggaactggtgccgctggtgatatcggccaagacccagcccgccctgaccgaacacgaagaccggctccgcgcctacctggcggcgtcgcccggagtggatatacgggctgtggcatcgacgctggcggtgacacggtcggtgttcgagcaccgcgccgtactccttggagatgaaaccgtcaccggcaccgcggtgtccgaccccaggatcgtgttcgtctttcccgggcagggatggcagtggctggggatgggcagtgcactgcgcgattcgtcggtggtgttcgccgagcggatggccgagtgcgcggcggcgttgagtgagtttgtggactgggatctgttcgccgtgctggatgatccggcggtggtggaccgggttgatgtggtccagcccgcttcctgggcggtgatggtttccctggccgcggtgtggcaggccgccggtgtgcggccggatgcggtgatcggccattcgcagggtgagatcgccgcggcgtgtgtggcgggtgcggtgtcgatgcgggatgccgcccggatcgtgaccttgcgcagccaggcgatcgcccggggcctggcgggccgtggtgcgatggcatccgtcgccctgcccgcacaggatgtcgagctggtcgacggggcctggatcgccgcccacaacggtcccgcctccaccgtgatcgcgggcaccccggaagcggtcgaccatgtcctcaccgctctgaggcaaaggggtgcgggtgcggcggatcacgtcgactacgcctcgcacaccccgcacgtcgagctgatccgcgacgaactgctcgacatcactagcgacagcagctcgcaggacccgctcgtgccgtggctgtcgaccgtggacggcacctgggtcgacagcccgctggacggggagtactggtaccggaacctgcgtgagccggtcggtttccaccccgccgtcagccagttgcaggcccagggcgacaccgtcttcgtcgaggtcagcgccagcccggtgctgatgcaggcgatggacgacgatgtcgtcacggttgccacgctgcgtcgtgacgacggggacgccacccggatgctcaccgccctggcacaggcctatgtccacggcgtgactgtcgactggcgcgcggtgctgggtgatgtcccggcaacacgggtgctggatcttccgacgtacgcgttccagcaccagcggtattgggctgaggccggccggtctgccgatgtgtcggcggcgggtctggatgcggtgggccacccgttgctgggtgcggtgctggcgatgccgggttcggatggtgtgatgctgaccgggcgggtatcactggccacccacgcgtggctggctgatcacgcggtccggggcagtgtcctgctgcccggtaccgggtttgtggagctggttgtccgcgcggctgatgaggtggcctgcgacgtcgttgacgagctgatcgtcgaagccccgcttctgctgccgcagaccggcggtgtgcaactgtccgtatccgtcggcgaggccgacgagtccggacaccgcgcggtgacggtcttctcccgggcggacagcgccgatgcctgggtccggcacgtttccgccaccgtcagcgtgtccgacacgactgtgccaacgtcggacctcaccgcgtggccaccagcgcaggccaagccggtggacgtggcaggcttctacgaccagctgaccagggcgggttacgagtacggacctgccttccagggtttgcaggccgcgtggcgtgatggtgacaccgtcttcgccgaggttgctctggctgaggagcagacccaggacgcggcacgattcgccgtccaccctgcggtgttggatgccgccctgcacgccgggatcctgaacacacccgatgccgaccgcgacaccgtgcggttgccgttctcctggaaccacgtccaggtccatgtcactggctcggccacgctgcgggtcgcgatgacacgggtcgcggatggctggggtgtgcgggtcgctgatgacatcggtcggccggtggccaccatcggctcgctggtgacccgtccggtggcagccgatgcgctcggttctgctgtcgatgatctgttcgccctgacgtggacggagatcccggtgtcccagcaggtcggcgtgacggtgggcaagtttgaagacctcgcggacggcgaggtgccgatgcccgatgtcgttgtgttcaccgcactccccgacagcggtgacccgctggcacagactcgtcggctgaccgctgaggttctgcaggcggtgcaggtctggctggcgggggagcgtttcactgacagtacgctggttgtgcggaccggaactggtttggccgcagccgcggtgtcggggttgatgcgttcggctcagtcggagcacccgggccggttcgtcctggtggaaagtgacgacgacaccctcaccccggaccaactggccgccaccgtcgggctcgatgagccgcggctgcgggtcatcgacggccggtacgaggcaccgcgactgactcgtacgggcgtcgctgagcctgagcctgaaggcgtctgggatccggatggcacggttctgatcaccggtggttcgggtgtgctggcggggatcgccgcccggcacctggtggccgaacgcggtgtgcgtcatctgctgttgctgtcccgcagcgccccggacgaggcgctgatcagcgagctggccgagttgggtgccgcggtggtggacacggcggtgtgcgacgtgtcggaccgtgccgggctggcgcgggtgctggcgggtgtgtcgccggaccatccattgacggcggtgattcacaccgcgggtgtgctggatgacggcgtcgtggaatcgttgacggcgcggcggctggacaccgtgctgcggcccaaggcggatggtgcgtggaacctgcacgagctcacccgcgatatcgaccttgccgcgttcgtcatgtactcctcggctgccggtgtgctcggtagtgcggggcagggtaactacgcggtggcgaacgcgttcgtggacgcgctggctgagcagcgtcgtgctgagggtctgccggccctcgcgctggcctggggcctgtgggaggacggaagagc

SEQ ID NO: 8 - DNA, 1156 bp, Artificial Sequence
  Synthetic
gctcttcggacgagccgttggcgattgtgggtatggcgtgccgtctgccgggtggggtgtcgtccccggaggatctgtggcgccttgtcgagtcgggtacggacgcgatttccggattccccgccgaccgtggctgggacgtcgagaacctgtacgaccctgatccggaggcggcaggcaagtcgtactgcgtgcagggcggcttcctggactccgcaggcggtttcgacgcctcgttcttcgggatcagtcctcgtgaggcgttggcgatggatccgcagcagcggctggtcctggaggcgtcctgggaagcgttcgaacgggccgggatcgaacccggttccctccgcggtagcgacaccggtgttttcatgggtgcgtaccccggtggctacggcgttggtgccgacctcggcggcttcggggcaactgccggtgcggtgagtgtcctgtcgggtcgggtgtcgtatttcttcggcctcgaggggccggctgtcacggtggacacggcgtgttcgtcgtcgttggtggcgttgcatcaggcggcgtatgccctgcggcagggtgagtgttcgctggccctggtcggtggtgtcactgtgatggccacgccgcaaagtttcgtggagttctcgcggcagcgtggcctggcctccgacggccggtgcaaggcgttcgcggatagtgcggacggcacgggggtacgcgtgtcgtacgccgcggacggcgccggcttctccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatggtgatggcgctgcagcgcggtttcgtgccgcgtacgttgcatggaagagc

SEQ ID NO: 9 - DNA, 670 bp, Artificial Sequence
  Synthetic
cctgggcaccgccacgacacgcgtacccccggctggcgccggtggagcgggagaaggcgctgctgaagctggtgtgtgatggcgccgcgacggttctgggacatgccgacgccagcacgattccggcgaccgcggcgttcaaggatctgggcatcgattcgctgaccgcggtggaactgcggaacagcctgacgaaggccacggggctgcggttgcccgccacgctggtgttcgactaccccaccccgacggccttggcagcccggctgggggagtggttcgtcggtgaaactcctgttccggtgcgtacgtcggtgtcggtggtggcgcaggacgagccgttggcgcgaagagcatgctcttcgggcctctgggagggcaccagcggcctgaccgccaatctgaccgatacagaccatgaccggatccggcgcagcggcatgcgggccatctccgccgagcatggaatgcggctgttcgacggcgcgtcacgccgcagggacccggttctggtggccgcggcgatggagccggtacgggaagccgaagtccccgcgatgctccggtcgttgcaccgcccggtcgcccggcgggcggcctccggtggtgcggtgcggtgcctggccgctctggcgccggaggaggtacgcgtgtcgtggcggtgcccagg

SEQ ID NO: 10 - DNA, 1090 bp, Artificial Sequence
  Synthetic
gctcttcggcgattgtcggcatggcgtgtcgcttgccgggtggggtgtcgtcgcctgaggatctgtggcgtcttctggagtcgggtacggacgcggtgtccggattccccaccgatcgtggctgggatgtggagaatctgttcggccccgcagctggcgactcctatcgcttgcagggtggtttcctggatgccgcggctggtttcgatgcctcgttcttcgggatcagtccgcgtgaggcgttggcgatggatccgcagcagcggttggtgctggaggtgtcctgggaggcgtttgagcgggccgggatcgagcccggttccgtacgcggaactgacaccggggttttcatgggtgcgtaccccggtggctacggcatcggtgccgacctcggcggcttcggcgccaccgcgagcgcggtcagtgtcctgtccggccgggtgtcgtacttcttcggcctcgaaggccctgccatcacggtggacacggcgtgttcgtcgtcgttggtggcgttgcaccaggcggggtatgccctgcggcagggtgagtgttcgctggccctggtcggtggtgtcaccgtgatggccacgccgcagactttcgtggagttcgctcgtcagggtggcctggccggtgacggtcgcagtaaggcgttcgcggacagtgcggacggcgccggcttctccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatggtgatggcgctgcagcgcggtttcgtgccgcgaagagc

SEQ ID NO: 11 - DNA, 3220 bp, Artificial Sequence
  Synthetic
gctcttcgccgcgtacgttgcatgtggatgagccgtcgcggcatgtggactggtcggcgggcgcggttgcgctggtgacggagaaccagccgtggccggatatgggccgagcgcgccgggcaggcgtgtcgtccttcgggatcagtggcaccaacgcccacgtcatcctggaaagcgcaccccccactcagcctgcggacaacgcggtgatcgagcgggcaccggagtggctgccgatggtgatttcggccaggacccagtcggctttgactgagcacgagggccggttgcgtgcgtatctggcggcgtcgcccggggtggatatgcgggctgtggcatcgacgctggcgatcacacggtcggtgttcgagcaccgggccgtgctgctgggagatgacaccgtcaccggtaccgcggcgaccgatccgcgggtggtgttcgtcttcccgggtcaggggtcgcagcgtgctggtatgggtgaggaactggccgccgcgttccccgtcttcgcgcggatccatcagcaggtctgggacctgctcgatgtgcccgatctggaggtgaacgaaaccgggtatgcccagccggccctgttcgctttgcaggtcgctctgttcgggttgctggaatcgtggggtgtacggccggatgcggtggtcggtcactctgtcggtgagctcgccgccggatacgtctccgggttgtggtcgttggaggatgcctgcactttggtgtcggcgcgggctcgtctgatgcaggctctgcctgcgggtggggtgatggtcgctgtcccggtgtcggaggatgaggcccgggccgtgctgggtgagggtgtggagatcgccgcggtcaacgggccgtcgtcggtggttctctccggtgatgaggccgccgtgctgcaggccgcggaggggctggggaagtggacgcggctggcgaccagccacgcgttccattccgcccgtatggagccgatgctggaggagttccgggcggtcgccgaaggcctgacctaccggacgccgcaagtctccatggccgctggtgatcagttgaccaccactgagtactgggtgcggcaggtccgggacacggtccggttcggcgagcaggtcgcctcgtacgaggacgccgtgttcgtcgagctgggtgccgaccggtcactggcccgcctggtcgacggcgtcgcgatgctgcacggcgaccacgaggcgcaggccgctgtcagtgccctggcccacctgtacgtcaacggcgtcaccgtcgactggcccgcgctcctgggcgatgctccggcaacacgggtgctggaccttccgacgtacgccttccagcaccagcgctactggctcgagggcacggaccggatggccgcgggcggccatccgctgctgggtgaggcggtggcggttcccggctcggatggtgtgctgttgaccgggcgggtgtcgttggccacgcacccgtggctggctgatcacgcggtgcggggcagtgtgctgctgcccggtaccgggtttgtggagctggtcgtccgcgccgccgacgaggtcggttgtgacgtcatcgacgagctggtgatcgagacgccgctcctgctgccgcagaccggaggcgtgcaactgtccgtcgcggtcgccgagtccgatgattccggacgccgggcggtgacggtcttctcccgggcggacaacgtcgatacctggacgcggcacgccacggtcacggtcagcaactctgatacgaccctctcgctgccagacctcagtgcgtggccaccagcccaggcccagccggtgaacgtggccgacttctacgatcagttgaccgtggtggcctacgagtacggtcccgcgtttcaggggctgcaggccgcgtggcgtgacggcgacaccgtccacgccgaggtcgccctcgccgaggagcaagcgcaggacgcggcccgaaacgccgtgcatcccgcgttgctggatgctgccctgcacgccgggatcctgaacacgcccgacaccgagcagggcgtgcggttgccgttctcctggaaccaggttcaggtccacgcggtcggctcggcgatgttgcgcgtcgccgtgacacaggcggcggacggctggagtgtgcgggtcgctgatgacaccggccggccggtggccaccatcggctccctcgtgactcggccggtgacggccgacacactcggctccaccaccgacgacctgctcgccctgacgtggacggagatcccggcccctcaggagacgagcctgaccataggccgcttcgaagacctggcggacgccgatgtgccggtgcccgaggtggtggtcttcaccgcacgccccgacagtagcgagaacccgctggcccagactcgtacgctgaccgcccaggtcctgcagaagatccaggcgtggctggccgaggaacgcttcaccgacagcacactgattgtgcggatcggcactggcttggcggctgccgcggtgtcgggtctgatgcggtcgggccagtcggaacatccgggccggtttgtcctggtggaaagcgacgacgacaccctcgcccccgaccagctggcggcgaccgtcgaattggatgagccgcggctgcggatcagcgacggccggttcgaagtgccacgactgacccgtacgcatgccgctgaacccgagtcagaaaaggtgtgggatccggatggcacggtcctgatcaccggtggttcgggtgtgctggcggggatcgccgcccggcacttggtggccgagcgtggcgtgcgtcatctgctgctgctgtcccgcagcgcaccggacggggcactgatcagcgagcttggcgaactgggcgcccaggtggccacagcggtttgcgacgtatcggatcgccctgggttggtgcgggtgctggcggacgtgtcaccggagcatcccctgacggcggtgattcataccgcgggtgtggtggacgacggtgtggtggagtccctgaccgcgcagcgactggacacggtactgcggcccaaggccgacggtgcctggcacctccacgagctcacccgtgacgccgacctggccgcgttcgtcatgtactcctcggccgccggtgtattcggtagcgcggggcaaggcaactatgcggtggcgaacgcgttcctggacgctctcgcagagcaacgtcgtgccgagggcctgcccgcactcgcactcgcctggggccgaagagc

SEQ ID NO: 12 - DNA, 595 bp, Artificial Sequence
  Synthetic
gctcttcgggcctctgggagggcaccagcggcctgaccgccaatctgaccgatacagaccatgaccggatccggcgcagcggcatgcgggccatctccgccgagcatggaatgcggctgttcgacggcgcgtcacgccgcagggacccggttctggtggccgcggcgatggagccggtacgggaagccgaagtccccgcgatgctccggagtttgcaccgcccggtcgcccggcgggcggccagtggaggtgcggtgcggtgcctggccgctctggcgccggaggagcgggcgaaggcactggtgaaggtggtgtgtgacagtgccgcgacggttctgggacacgccgacgtcgacagtattccggtgaccgccgcgttcagggatctgggcgtggattcgctgacggcggtggaactacggaacagcctgacgaaggccacgggactgcggctgcccgccacgttggtgttcgactacccgaccccaggtgccctggccgcccggttggaggagctgttcaccggcgagaatcctgttcaggtacgcacgccggtgtcggcggtggggcaggacgagccgttggcgcgaagagc

SEQ ID NO: 13 - DNA, 1171 bp, Artificial Sequence
  Synthetic
cctgggcaccgccacgacacgcgtaccacagtgcggacggcgccggcttctccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatggtgatggcgctgcagcgcggtttcgtgccgcgaagagcatgctcttcggcgatcgtgggcatggcctgccgcctgcctggtggggtgtcgtcgcctgaggatctgtggcgccttgtggaatcgggtacggatgcgatttccggtttccccaccgaccgtggctgggacgtggagaacctgttcgactcggatccggatgcggccgggaagtcgtactgcgtagagggtggcttcctggcgaccgctgccaacttcgatgcctcgttcttcgggatcagtccgcgtgaggcgttggcgatggatccgcagcagcggctggtgctggaggtgtcctgggaggcgttcgagcgggctgggatcgagcccggttccgtacgcggcagcgacaccggcgtcttcatgggcgctttcccgggcggttacggcatcggcgcagacctcgaaggttatggtgcgaccgctggcctcaacgtgctgtccggccggctgtcgtacttcttcggtcttgaggggccggccgtcacggtggacacggcgtgttcctcgtcgctggtcgccctgcaccaagcggggtatgccctgcgacagggtgagtgctcgctggccctgatcggcggtgtgaccgtgatggccacaccacataccttcgtggagttctcccggcagcgtggcctggcatccgatggccggtgcaaggcgttcgccgacagcgcggacggcacgggggtacgcgtgtcgtggcggtgcccagg

SEQ ID NO: 14 - DNA, 2611 bp, Artificial Sequence
  Synthetic
gctcttccgcggcagcggtgtcggggttgatgcgctcggcccagtccgaacaccccggccggttcatcctggtggaaagtgatgacgacgccctcactccggaccagctggccgcgactgtcggattggacgagccgcggctgcggatcagcgacggccggtacgaagtaccacggctgacccgcgcacatgccgatgagcctgagcctgaaagggcgtgggatccggatggcacggtcctgatcacgggcggttccggcgttctggcggggatcgtcgcccggcacctggtggccgaacgtggtgtgcgtcatctcctgctgctgtctcgcggcactccggaccgggcgctgctcagcgagttggccgagttgggtgccgcggtggacacagcggcctgtgacgtgtcggatcgtgcagagctggcgcgagtgttggcgcgtgtgtcgccggagcacccgttgacggcggtgattcataccgcgggcgtggtggatgacggtgtcgtggagtccctgagcgcgcagcggctggaaaccgtattccggcccaaggccgatggtgcttggcatttgcacgagctcacccgggacgccgacctggcggcgttcgtcatgtattcctcggctgccggtgtcatggccggtgcgggtcagggtaactacgcggcggcaaacgcgttcctggacgcgctcgccgaagaacgccgagccgagggcctgcccgcactcgcggtggcctggggcctctgggaggacgccagcggcctgaccgcgcaactgaccgacacggaccgtgaccggatccggcgcggtggcctgcgggccatctccgccgagcacgggatgcggctgttcgacaacgcgtcacgccacagtgaaccggttctggtggccgcgccgatggagccggtacgggacgcggaagtcccggcattgctgcggtcgttgcatcgtccgaacgtccggcgtgccgctctcgccggtggagcgcagtggctggcagccctggcgccggaggagcgggcgaaggcactgctgaaggtggtgcgtgacaccgccgcgacggttctggggcacgccgatgcccgcaccattccggtgaccggagcgttcagggatctgggcattgattcgctgaccgcggtggaactacggaacggtctggcgaaggtgacggggttgcggttgccggccacgttggtgttcgactatccgaccccggcggtcttggctgctcggctgggggagttgttcaccggcgagaatcctgtattggtgcgcaccgcctcggtggtggggcaggacgagccgctggcgatcgtgggtatggcctgccgtctgcccggcggcgtgtcgtcgcctgaggatctgtggcgccttgtggagtcgggtacggatgcgatttccggtttccccgccgaccgtgggtgggacgcggagagcctgttcgatccggacccggacgcggtcgggaagtcgtactgcgtagagggcggcttcctcgacagcgcagccagcttcgacgccggattcttcggcatcagcccacgcgaggctctggcgatggacccgcagcagcggctgatcatggaggtgtcctgggaggccttcgagcgggccgggatcgagcccggttccgtgcgcggcagcgacaccggcgtcttcatgggcgcgtacgccggtggctacggtgccggtgctgacctcggcggcttcgcggccaccgccagcgcgaccagtgtcctgtccggccgggtgtcgtacttcttcggcctcgaaggccccgccatcacggtggacacggcgtgttcgtcgtcgctggtggcattgtaccaggcggggtatgccctgcggcagggggagtgttccctggccctggtcggtggtgtcacggtgatggccacgccgcaaagtttcgtggagttctcgcggaagagtggtcttgactccgatggccggtgcaaggcgttcgcagacagcgcggatggcacgggatgggctgaaggcgttggtgtgctgctggtagagcggctttccgacgcccaggccaagggccatcaggtgttggcggtggtccgtagctcggcggtcaaccaggacggcgcgtcgaacggcctgtccgcgccgaacggcccctcccagcagggggtgattcggcaggcgctggccaacgcgggtctgaccacggccgaggtggatgtggtcgaggcccacggcacgggtacgacgctgggcgacccgatcgaggcccaggcggtgatcgccacttacggtcaggaccgggaacggcccctgctgctgggctcgctgaagtcgaacatcggtcatgctcaggccgcctcgggcgtgtcgggcagcgtggtacgcgtgtggagcgacgtcgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatggtgatggcgctgcagcgcggtttcgtgccgcgtacgttgcatggaagagc

SEQ ID NO: 15 - DNA, 40 bp, Artificial Sequence
  Synthetic
tagaaatctgcattaatttccccgaaaagtgccacctggg

SEQ ID NO: 16 - DNA, 49 bp, Artificial Sequence
  Synthetic
ttggccgattcattaatgatgcggtattttctccttacgcatctgtgcg

SEQ ID NO: 17 - DNA, 3521 bp, Artificial Sequence
  Synthetic
gctcttcacgcgcctacctggcggcgtcgcccggagtggatacacgggctgttgcatcaacgctcgcggtgacacggtcggtgttcgagcaccgcgccgtactccttggagacgacaccgtcaccggcaccgctgtgtccgatccccgggtggtgtttgttttcccggggcaggggtggcagtggctggggatgggcagtgcgctgcgcgattcctcgatcgtgttcgccgagcggatggccgagtgcgcgcccgcgttgcgcgagttcgtggactgggacctgttcacggttctggatgatccggcggtggtggaccgggttgatgtggtccagcccgcttcctggcggatgatggtgtccctggccgcggtgtggcaggcggccggtgtgcggccggatgcggtgatcggccattcacagggtgagatcgccgcggcgtgtgtggcgggtgcggtgtcgatgcgggatgccgcccggatcgtgaccttgcgcagcgaggcgatcgcccggggcctggcgggccggggcgcgatggcatccgtcgccctgcccgcacaggatgtcgagctggtcgacggggcctggatcgccgcccacaacggtcccgcctccaccgtgatcgcgggcaccccggaagcggtcgaccatgtcctcaccgctcatgaagcgcgaggggtgcgggtgcggcggatcaccgtcgactacgcctcgcacaccccgcacgtcgagctgatccgcgacgaactgctcgacatcactagcgacagcagctcgcaggccccggtcgtgccgtggctgtcgaccgtggacggctcctgggtcgacagcccgctcgatgtggagtactggtaccggaacctgcgtgagccggtcggtttccaccccgccgtcggccagttgcaggccgagggtgacaccgtgttcgtggaggtcagcgccagcccggtgttgttgcaggcgatggacgacgatgtcgtcacggttgccacgctgcgtcgtgacgacggcgacgccacccggatgctcaccgccctggcacaggcctatgtccacggcgtcaccgtcgactggcccgccatcctcggcaccgccacaacccgggtactggaccttccgacctacgccttccagcaccagcggtactggctcaggagcgtggaccgggcggctgccgacggtcatccactgctgggcaccgtagtggacctgccggcctccgacggtgtggtgctcaccgggcgggtgtcgctggccacccatacatggctggccgatcacgcggtccggggcagtgtcctgctacccgggaccgcatttgtggacctggtcgtccgcgccgccgacgaggtcgagtccgacgtcgttgacgagttggtgatcgaaaccccgctcctgctgccgcagaccggaggcgtccaactgtccgtgtccgtcggcggagccgacgagtccgggcaccgcgcggtgatggtcttctcccaggcggacaacaccgatacctggacccggcacgtcacggcgacagtcagcacctctgactcgacggtgtcgctgccggagtttgcctcgtggccaccagcccaggcccggccggtgagcgtggccgacttctacgaccggctggctgcggcaggtaccgagtacggtcccgcgttccaggggctgcaggccgcgtggcgtgacggggacaccgtctacgccgaggtcgtcctcgctgaggagcaggcgcaggaggcggcacggttcgcggtgcatccggcgctgttggacgccgccatgcacgccagcgtcctgcacacacccgataccgaccagcagagcgtgcggatgccgttctcctggaaccacgtccaaatccgagcgaccgacacagccatgctgcgcgtcgcggcaacaccgacaacagacggctggagtgtgcgggtcgccgacgacaccggcaggcccgtggccaccatcggttccctcgtcacccggccggtgacagccgacacactcggctccgctgccgatgacctgctcacgctggtatggacggagatcccgactccccagcagagcagcctgagcgtcggcaggtacgaagacctggcggacggtgacgtgccggtccccgacgtggcggtctacaccgcacgtcccgaggccgacggcagccctgatccgctggtacagactcgtacgctgaccgcccaggtgctccagacggcccaggcgtggcttggcggggagcgcttcaccgacagcacactggtcgtgcggaccggcaccgggctggccgccgccgcggtgtcagggctgatgcgttcagcccagtcggaacaccccggccgcttcgtcctggtggaaagcgacgacgacagcctcaccctccaccaactggccgctaccgtcggactggacgagccccgcctgcgggtcaacgacggccggttcgaagtgccacggctggcccgggtgaacgccgctgagcccgaatctgaaacggtgtgggacccgcatggcacggtcctgatcacaggcggctccggcgtcctggcaggcgccctcgcccgccacctggtcaccgaacgtggcgtacgtcatctcctgctgctgtcccgcaccactgccgacgaggggttgctcaacgaactcggcgagctgggcgctcgggtcgagacggcggactgcgacgtgtcggaccgtgccgggctggcgcgggtgctggcgggcgtatcaccggaacacccgctgacggcggtgatccaaaccgccggcgcactcgacgacggcgtcttggaaaccctgaccgcgcagcggctggacacggtcctacggcccaaagccgacggcgcctggcatctgcacgaactcactcgcaacaccggcctggccgcgttcgtcatgtattcctcggccgccggtgtcatgggtaatccggggcagggcaacctcgcggcggccaccgcgttcttggacgcgctggccgaccaacgtcgtgccgaggggctgcccgcactcgcactcgcctggggttcgtcagaagaaaccagtgacctgatcggtctgcggaccatctccgccgagcgtgggatgcgcctgttcgacagcgcatcgcatcgtggcgagccgcttctgatggccgcgtcgctggatccggcacgggccgcggaggttccggcgttgctgcgttcgttgcgtcgcccggtcgcccggcgggccgcttccgccgacggtggggtgcagtggctggccgccctggcaccggccgagcgggagaaggcgctgctgaaggtggtgtgtgacagtgccgccgtggtcctggggcacgccgacgcccgcaccattcccgtgaccggtgcgttcaaggatttgggcgtggattcgctgaccgcggtggagctgcggaacagcctggtgaaggcgacggggctgcggctgcccgccacgatggtgttcgactatcccaccccgaccgccttggctgctcggttggacgagttgttcaccggcgagaaccctgcaccggagaagagc

SEQ ID NO: 18 - DNA, 530 bp, Artificial Sequence
  Synthetic
gctcttcacgaggtggatgtggtcgaggcccacggcacgggtacgacgctgggcgacccgatcgaggcccaggcggtgatcgccacttacggtcaggaccgggaacggcccctgctgctgggctcgctgaagtcgaacatcggtcatgctcaggccgcctcgggcgtgtcgggtgtcatcaagatggtcatggccctgcagcacaacacggttccccgcaccctgcacgtggatgagccgtcgcggcacgtggactgggcggcgggtgcggttgagctggtgagggagaaccagccctggcccggcaccgaccggccccgtcgggcgggcgtgtcgtccttcggagtcagcggcaccaacgcccacgtcatcctggagagcgcaccccccgctcagcccgcggaggaggcgcagcctgttgagacgccggtggtggcctcggatgtgctgccgctggtgatatcggccaagacccagcccgccctgaccgaacacgaagaccggctgcgcgcctacctggcgagaagagc

SEQ ID NO: 19 - DNA, 1108 bp, Artificial Sequence
  Synthetic
gctcttcaagaaccctgcaccggtacgcgagccggtgccggcggtggcgcaggacgagccgttggcgattgtcggtatggcgtgccgtctgccgggcggtgtgtcgtcgccggaggatctgtggcgcttggtcgagtcgggtacggacgcggtgtccggctttcccaccgaccgtggctgggacgtcgagggcctgttcgatccggatccggacgcggccgggaagtcgtaccgcgctgagggcggcttcctggacacggcggctggcttcgacgccggattcttcgggatcagtccgcgtgaggcgttggcgatggatccgcagcagaggctgctgttggaggtgtcctgggaggccttcgagcgggccgggatcgagcccggttccgtacgcggcagcgacaccggcgtcttcattggcgcgttccccgttggttacggcgccggtgctgcccgcgagggttacggtgcgaccgcggctcccaacgtgttgtccggccggctgtcgtacttcttcggccttgagggtccggcgatcacgatggacacggcgtgctcctcgtccctggttgctttgcatctggcggcgcaggcgttgcgcaatggtgagtgttcgatggcgttggccggtggtgtgacggtgatggccacgccggaggtcttcaccgagttcgcccggcagcgtggtctggcctccgacggccggtgcaaggcgttcgcggacagtgcggatggtgccggtttctccgaaggcgcgggtctgctgctggtcgagcggctctccgacgcccgccgcaacggccaccaggtgctcgcagtcgttcgcggatcggcagtcaaccaagacggcgcgtccaacggcttcacggcgccgaacggacccgcccagcagcgggtgatccggcaggcgctggccaacgcgggtctgaccaccgccgaggtggatgtggtcgaggcacacggcacgggtacgacgctgggtgacccgatcgaggcccaggcggtgatcgccacctacggtcaggaccgtgagcagcctctgctgctgggcacattgaagtcgaacgtcggacatacgcaggctgccgccggtgtgtcggagaagagc

SEQ ID NO: 20 - DNA, 40 bp, Artificial Sequence
  Synthetic
agcttgctcttcgcgaggtggatgtggtcgtccactggag

SEQ ID NO: 21 - DNA, 40 bp, Artificial Sequence
  Synthetic
tcgactccagtggacgaccacatccacctcgcgaagagca

SEQ ID NO: 22 - DNA, 40 bp, Artificial Sequence
  Synthetic
tcgactccagcgggtgccgccggtgtgtcggggaagagct

SEQ ID NO: 23 - DNA, 40 bp, Artificial Sequence
  Synthetic
ctagagctcttccccgacacaccggcggcacccgctggag

SEQ ID NO: 24 - DNA, 40 bp, Artificial Sequence
  Synthetic
agcttgctcttcgtgaggtggatgtggtcgtccactggag

SEQ ID NO: 25 - DNA, 40 bp, Artificial Sequence
  Synthetic
tcgactccagtggacgaccacatccacctcacgaagagca

SEQ ID NO: 26 - DNA, 40 bp, Artificial Sequence
  Synthetic
tcgactccagcgggcgcctcgggcgtgtcggggaagagct

SEQ ID NO: 27 - DNA, 40 bp, Artificial Sequence
  Synthetic
ctagagctcttccccgacacgcccgaggcgcccgctggag

SEQ ID NO: 28 - DNA, 3383 bp, Artificial Sequence
  Synthetic
gctcttcaatctggcggcgtcgcccggggtggatatgcgggctgtggcatcgacgctggcgatgacacggtcggtgttcgagcaccgtgccgtgctgctgggagatgacaccgtcaccggcaccgctgtgtctgaccctcgggcggtgttcgtcttcccgggacaggggtcgcagcgtgctggcatgggtgaggaactggccgccgcgttccccgtcttcgcgcggatccatcagcaggtctgggacctgctcgatgtgcccgatctggaggtgaacgagacgggttacgcccagccggccctgttcgcaatgcaggtcgctctgttcgggctgctggaatcgtggggtgtacgaccggacgcggtgatcggccattcggtgggtgagcttgcggctgcgtatgtgtccggggtgtggtcgttggaggatgcctgcactttggtgtcggcgcgggctcgtctgatgcaggctctgcccgcgggtggggtgatggtcgctgtcccggtgtcggaggatgaggcccgggccgtgctgggtgagggtgtggagatcgccgcggtcaacggcccgtcgtcggtggttctctccggtgatgaggccgccgtgctgcaggccgcggaggggctggggaagtggacgcggctggcgaccagccacgcgttccattccgcccgtatggaacccatgctggaggagttccgggcggtcgccgaaggcctgacctaccggacgccgcaggtcagcatggccgttggtgatcaggtgaccaccgctgagtactgggtgcggcaggtccgggacacggtccggttcggcgagcaggtcgcctcgtacgaggacgccgtgttcgtcgagctgggtgccgaccggtcactggcccgcctggtcgacggtgtcgcgatgctgcacggcgaccacgaaatccaggccgcgatcggcgccctggcccacctgtatgtcaacggcgtcacggtcgactggcccgcgctcctgggcgatgctccggcaacacgggtgctggaccttccgacatacgccttccagcaccagcgctactggctcgagggcacggaccgggcgactgcgggtggccatccgttgctgggttcggcggtgcggctggccgaggccagcggggtgttgttcactgcccgggtttcccggagcggcgatctgtggctgcgggaccagacggttctgcccgcgacggtgttcgtggagatggcgctggcagcggcggacgaggccggctgcggtctggttgaggacctgaacgtggaagcgttgctgctgcttcctgacgatggcgccgtccaggtacagacctgggtgagcgaaccggacgaggccggtcgccaccggctcagtatccacgcccgttacagcgacagcgagccctggacacgcttggccaccgcaaccctcgccaccaggggaacggtatccggctggcaggccggggaggcgtggccgccgaccggtgcggtcccggtcgagacgggagtgccgtcactgcgcggggtgtggcgccgaggcaacgaagtgttcgccgaggtcgccctggacagcacccacgacgccaccacatacgccctgcaccctgccctcctgaccgccgccctcaccaccgccggtgaggaaacccccgccgcgtggcaggcgctgaccctgcacgcccgcaaccctgccgagctgcgcgtccgcctcatctcacacgatgacggcaccctgtccgtggacgccaccgacagcacaggcctccccgtcctgaccgtccgctccctcaccctgcgcaccgtccccgtctacgaacctgccaccagcaccgacgacctgctcaccctgacctgggcggagatcccggcccctcaggaaaccggcctgacggtcggccggttcgaggacctggtgtcggacgctgatgtgccggtacccgaggtggcggtcttcaccgcactccccgacagcagcgagaacccgctggaacagacccgcgtactgaccgctcaggtcctccaggcagtccagacctggcttggcggggaacgtttcaccgacagcacgctggtcgtgcggaccggcacccggttggccgccgctggggtgtcggggttgatgcgatcggctcaatcggaacaccccggccggttcgtcctggtcgagagcgacgacgacacgctcgccccggaccagttggccgccaccgtcgggctcgacgagccgcggctgcgggtcagcggcgaccggtacgaggcaccgcgactggctcgtgtgaacgccagtgggtctgagcctgaagcggtttgggatccggatggcacggttctgatcaccggtggttcgggtgtgctggcggggatcgccgcccggcacctggtggccgaacgcggcgtgcgtcatctgctgctgctgtcccgcagcgccccggacgaggcactgatcaaccaactcggcgaactgggcgcccgggtcgagacagcggcctgtgacgtgtccgatcgtgccgcgctggcccaggtgctggcgggtgtgtcaccggagcaccccctgacggcagtgattcacaccgcgggcgtactcgatgacggtgttgtcgagtccctgaccgcgcagcggctcgacacggtactgcggcccaaggccgacggcgcctggcatctgcacgaactcacccgcaacaccgacctggccgccttcgtcatgtactcctccgccgccggtgtcatgggcggtggggggcaaggtaactacgcggcggcaaacgcgttcctggacgcgctcgccgaagaacgccgcgccgagggcctgcccgcaattcgcggtggcctgggtctgtgggaggacaccagtggcctgaccacgcaactgaccgacacggaccgtgaccggatccggcgcggtggcctgcggactatcaccgccgagtacgggatgcggctgttcgacaccgcatcacgccatggcaacccgattctggtcgccgcaccgatggacccggtttgggacgcggaagtccccgcgctcctccgctcgttgcatcgtcccgtcgcccggcgggccgcctctaccagcgactcgtcagcgcggtggctggcggccctggcaccggccgagcgggaagacgcactgctgaagctggtgcgtgacagcgccgctctggtcctgggacacgctgacgccagcaccatccccgcagccgccgcattcaaggatctgggtatcgattcgctgaccgcggtggaactgcgcaacagcctggcgaaagccacagggctgcggctgcccaacacgacggtgttcgactaccccaccccggccatcctggccacccggctgggtgagctgttcaccggcgagaaccctgcaccggtgcgagaagagc

SEQ ID NO: 29 - DNA, 525 bp, Artificial Sequence
  Synthetic
gctcttcatgaggtggatgtggtcgaggcgcacggcacgggcacaacgctgggtgacccgatcgaggcccaggcgctgatcgctacctatggccaggaccgtgaccagcctgtgctgctgggttcggtgaagtcgaacctgggtcatacgcaggccgctgcgggtgtgtccggtgtcatcaagatggtgatggccctgcaacacggtctggtgccgcgcacgttgcatgtcgatgagccgtcacggcatgtggactggtcggcgggcgcggtgcagctcgtgacggagaaccagccgtggccggatatgggccgagcgcgccgggcaggcgtgtcgtccttcgggatcagtggcaccaacgcccacgtcatcctggaaagcgcaccccccactcagcctgcggacaacgcggtgatcgagcgggcaccggagtgggtgccgttggtgatttcggccaggacccagtcggctttgactgagcacgagggccggttgcgtgcgtatctggcggcgtcgcagaagagc

SEQ ID NO: 30 - DNA, 1104 bp, Artificial Sequence
  Synthetic
gctcttcaccctgcaccggtgcgcccgtcggtgtcggtggtggggcaggacgagccgctggcggtcgtgggtatggcctgccgtctgcccggcggggtgtcgtcgcctgaggatctgtggcgccttgtggagtcgggtacggatgcgatttccggtttccccgccgaccgtgggtgggacgcggagagcctgttcgatccggacccggacgcgtcgggcaagtcgtactgcgtagagggcggcttcctcgacagcgcaggcagcttcgacgccggattcttcggcatcagcccacgcgaggctctggcgatggacccgcagcagcggctgatcatggaggtgtcctgggaggccttcgagcgggccgggatcgagcccggttccgtgcgcggcacacaccggcgtcttcatgggcgcgtacgcggtggctacggtgccggtgctgacctcggcggcttcgcggccaccgccagcgcgaccagtgtcctgtccggccgggtgtcgtacttcttcggcctcgaaggccccgccatcacagtcgacacagcctgctcgtcatcactggtggcactgcaccaggccgggtatgccctccggcagggagagtgttccctggccctggtcggcggcgtcaccgtgatggccacaccacaaagcttcgtggaattctcccgccagcgtggtctggcctccgatggccggtgcaaggcgttcgcagacagcgcggacggcacgggatgggctgaaggcgttggtgtgctgctggtagagcggctttccgacgcccaggccaagggccatcaggtgttggcggtggtccgtagctcggcggtcaaccaggacggcgcgtccaacggtctgaccgcgccgaacggtccttcgcagcagcgggtgatccaagccgctctcagtaacgccggcctcgccgcgcacgaggtggatgtggtcgaggcccacggcacgggcacgacgctgggcgacccgatcgaggcccaggcgctgatcgccacttacggtcaggaccgggaacggcccctgctgctgggttcgctgaagtcgaacatcggtcatgctcaggccgcctcgggcgtgtcggagaagagc

SEQ ID NO: 31 - DNA, 2611 bp, Artificial Sequence
  Synthetic
gctcttccgcggcagcggtgtcggggttgatgcgctcggcccagtccgaacaccccggccggttcatcctggtggaaagtgatgacgacgccctcactccggaccagctggccgcgactgtcggattggacgagccgcggctgcggatcagcgacggccggtacgaagtaccacggctgacccgcgcacatgccgatgagcctgagcctgaaagggcgtgggatccggatggcacggtcctgatcacgggcggttccggcgttctggcggggatcgtcgcccggcacctggtggccgaacgtggtgtgcgtcatctcctgctgctgtctcgcggcactccggaccgggcgctgctcagcgagttggccgagttgggtgccgcggtggacacagcggcctgtgacgtgtcggatcgtgcagagctggcgcgagtgttggcgcgtgtgtcgccggagcacccgttgacggcggtgattcataccgcgggcgtggtggatgacggtgtcgtggagtccctgagcgcgcagcggctggaaaccgtattccggcccaaggccgatggtgcttggcatttgcacgagctcacccgggacgccgacctggcggcgttcgtcatgtattcctcggctgccggtgtcatggccggtgcgggtcagggtaactacgcggcggcaaacgcgttcctggacgcgctcgccgaagaacgccgagccgagggcctgcccgcactcgcggtggcctggggcctctgggaggacgccagcggcctgaccgcgcaactgaccgacacggaccgtgaccggatccggcgcggtggcctgcgggccatctccgccgagcacgggatgcggctgttcgacaacgcgtcacgccacagtgaaccggttctggtggccgcgccgatggagccggtacgggacgcggaagtcccggcattgctgcggtcgttgcatcgtccgaacgtccggcgtgccgctctcgccggtggagcgcagtggctggcagccctggcgccggaggagcgggcgaaggcactgctgaaggtggtgcgtgacaccgccgcgacggttctggggcacgccgatgcccgcaccattccggtgaccggagcgttcagggatctgggcattgattcgctgaccgcggtggaactacggaacggtctggcgaaggtgacggggttgcggttgccggccacgttggtgttcgactatccgaccccggcggtcttggctgctcggctgggggagttgttcaccggcgagaatcctgtattggtgcgcaccgcctcggtggtggggcaggacgagccgctggcgatcgtgggtatggcctgccgtctgcccggcggcgtgtcgtcgcctgaggatctgtggcgccttgtggagtcgggtacggatgcgatttccggtttccccgccgaccgtgggtgggacgcggagagcctgttcgatccggacccggacgcggtcgggaagtcgtactgcgtagagggcggcttcctcgacagcgcagccagcttcgacgccggattcttcggcatcagcccacgcgaggctctggcgatggacccgcagcagcggctgatcatggaggtgtcctgggaggccttcgagcgggccgggatcgagcccggttccgtgcgcggcagcgacaccggcgtcttcatgggcgcgtacgccggtggctacggtgccggtgctgacctcggcggcttcgcggccaccgccagcgcgaccagtgtcctgtccggccgggtgtcgtacttcttcggcctcgaaggccccgccatcacggtggacacggcgtgttcgtcgtcgctggtggcattgtaccaggcggggtatgccctgcggcagggggagtgttccctggccctggtcggtggtgtcacggtgatggccacgccgcaaagtttcgtggagttctcgcggaagagtggtcttgactccgatggccggtgcaaggcgttcgcagacagcgcggatggcacgggatgggctgaaggcgttggtgtgctgctggtagagcggctttccgacgcccaggccaagggccatcaggtgttggcggtggtccgtagctcggcggtcaaccaggacggcgcgtcgaacggcctgtccgcgccgaacggcccctcccagcagggggtgattcggcaggcgctggccaacgcgggtctgaccacggccgaggtggatgtggtcgaggcccacggcacgggtacgacgctgggcgacccgatcgaggcccaggcggtgatcgccacttacggtcaggaccgggaacggcccctgctgctgggctcgctgaagtcgaacatcggtcatgctcaggccgcctcgggcgtgtcgggcagcgtggtacgcgtgtggagcgacgtcgaagtggacgtcgtcgaggcgcatggcacgggcacgacgcttggtgacccgatagaagcccaagcgttgctggcgacctatggccaggatcgtgagcagccgttgctgctgggttcggtgaagtcgaatctgggtcatacgcaggctgctgcgggtgtgtcgggtgtcatcaagatggtgatggcgctgcagcgcggtttcgtgccgcgtacgttgcatggaagagc

SEQ ID NO: 32 - DNA, 1108 bp, Artificial Sequence
  Synthetic
gctcttcaagaaccctgcaccggtacgcgagccggtgccggcggtggcgcaggacgagccgttggcgattgtcggtatggcgtgccgtctgccgggcggtgtgtcgtcgccggaggatctgtggcgcttggtcgagtcgggtacggacgcggtgtccggctttcccaccgaccgtggctgggacgtcgagggcctgttcgatccggatccggacgcggccgggaagtcgtaccgcgctgagggcggcttcctggacacggcggctggcttcgacgccggattcttcgggatcagtccgcgtgaggcgttggcgatggatccgcagcagaggctgctgttggaggtgtcctgggaggccttcgagcgggccgggatcgagcccggttccgtacgcggcagcgacaccggcgtcttcattggcgcgttccccgttggttacggcgccggtgctgcccgcgagggttacggtgcgaccgcggctcccaacgtgttgtccggccggctgtcgtacttcttcggccttgagggtccggcgatcacgatggacacggcgtgctcctcgtccctggttgctttgcatctggcggcgcaggcgttgcgcaatggtgagtgttcgatggcgttggccggtggtgtgacggtgatggccacgccggaggtcttcaccgagttcgcccggcagcgtggtctggcctccgacggccggtgcaaggcgttcgcggacagtgcggatggtgccggtttctccgaaggcgcgggtctgctgctggtcgagcggctctccgacgcccgccgcaacggccaccaggtgctcgcagtcgttcgcggatcggcagtcaaccaagacggcgcgtccaacggcttcacggcgccgaacggacccgcccagcagcgggtgatccggcaggcgctggccaacgcgggtctgaccaccgccgaggtcgatgtggtggaggcacacggtaccggtactaccctgggtgatcctatcgaggcacaggcagtcatcgctacctacggccaggaccgtgagcagcctctgctgctgggcacattgaagtcgaacgtcggacatacgcaggctgccgccggtgtgtcggagaagagc

SEQ ID NO: 33 - DNA, 40 bp, Artificial Sequence
  Synthetic
agcttgctcttcgtgaggtcgatgtggtggtccactggag

SEQ ID NO: 34 - DNA, 40 bp, Artificial Sequence
  Synthetic
tcgactccagtggaccaccacatcgacctcacgaagagca

SEQ ID NO: 35 - DNA, 525 bp, Artificial Sequence
  Synthetic
gctcttcatgaggtcgatgtggtggaggcacacggtaccggtactaccctgggtgatcctatcgaggcacaggcactgatcgctacctatggccaggaccgtgaccagcctgtgctgctgggttcggtgaagtcgaacctgggtcatacgcaggccgctgcgggtgtgtccggtgtcatcaagatggtgatggccctgcaacacggtctggtgccgcgcacgttgcatgtcgatgagccgtcacggcatgtggactggtcggcgggcgcggtgcagctcgtgacggagaaccagccgtggccggatatgggccgagcgcgccgggcaggcgtgtcgtccttcgggatcagtggcaccaacgcccacgtcatcctggaaagcgcaccccccactcagcctgcggacaacgcggtgatcgagcgggcaccggagtgggtgccgttggtgatttcggccaggacccagtcggctttgactgagcacgagggccggttgcgtgcgtatctggcggcgtcgcagaagagc

SEQ ID NO: 36 - DNA, 1104 bp, Artificial Sequence
  Synthetic
gctcttcaccctgcaccggtgcgcccgtcggtgtcggtggtggggcaggacgagccgctggcggtcgtgggtatggcctgccgtctgcccggcggggtgtcgtcgcctgaggatctgtggcgccttgtggagtcgggtacggatgcgatttccggtttccccgccgaccgtgggtgggacgcggagagcctgttcgatccggacccggacgcgtcgggcaagtcgtactgcgtagagggcggcttcctcgacagcgcaggcagcttcgacgccggattcttcggcatcagcccacgcgaggctctggcgatggacccgcagcagcggctgatcatggaggtgtcctgggaggccttcgagcgggccgggatcgagcccggttccgtgcgcggcacacaccggcgtcttcatgggcgcgtacgcggtggctacggtgccggtgctgacctcggcggcttcgcggccaccgccagcgcgaccagtgtcctgtccggccgggtgtcgtacttcttcggcctcgaaggccccgccatcacagtcgacacagcctgctcgtcatcactggtggcactgcaccaggccgggtatgccctccggcagggagagtgttccctggccctggtcggcggcgtcaccgtgatggccacaccacaaagcttcgtggaattctcccgccagcgtggtctggcctccgatggccggtgcaaggcgttcgcagacagcgcggacggcacgggatgggctgaaggcgttggtgtgctgctggtagagcggctttccgacgcccaggccaagggccatcaggtgttggcggtggtccgtagctcggcggtcaaccaggacggcgcgtccaacggtctgaccgcgccgaacggtccttcgcagcagcgggtgatccaagccgctctcagtaacgccggcctcgccgcgcacgaagtggacgtcgtcgaggcgcatggcacgggcacgacgcttggtgacccgatagaagcccaagcgttgatcgccacttacggtcaggaccgggaacggcccctgctgctgggttcgctgaagtcgaacatcggtcatgctcaggccgcctcgggcgtgtcggagaagagc

SEQ ID NO: 37 - protein, 414 aa, Streptomyces rapamycinicus
AIVGMACRLPGGVSSPEDLWRLLESGTDAVSGFPTDRGWDVENLYDMAGKSHRAEGGFLDAAAGFDAGFFGISPREALAMDPQQRLVLEVSWEAFERAGIEPGSVRGSDTGVFMGAYPGGYGAGADLGGFAATASATSVLSGRVSYFFGLEGPAFTVDTACSSSLVALHQAGYALRQGECSLALVGGVTVMATPELFTEFSRQRGLASDGRCKAFADSADGTGWAEGVGVLLVERLSDAQAKGHQVLAVVRSSAVNQDGASNGLTAPNGPSQQRVIQAALSNAGLAAHEVDVVEAHGTGTTLGDPIEAQAVIATYGQDRERPLLLGSLKSNIGHAQAASGVSVVIKMVMALQHNTVPRTLHVDEPSRHVDWAAGAVELVRENQPWPGTDRPRRAGVSSFGVSGTNAHVILESAP

SEQ ID NO: 38 - protein, 418 aa, Streptomyces rapamycinicus
AIVGMACRLPGGVSSPEDLWRLVESGTDAISGFPADRGWDAESLFDPDPDAVGKSYCVEGGFLDSAASFDAGFFGISPREALAMDPQQRLIMEVSWEAFERAGIEPGSVRGSDTGVFMGAYAGGYGAGADLGGFAATASATSVLSGRVSYFFGLEGPAITVDTACSSSLVALYQAGYALRQGECSLALVGGVTVMATPQSFVEFSRKSGLDSDGRCKAFADSADGTGWAEGVGVLLVERLSDAQAKGHQVLAVVRSSAVNQDGASNGLSAPNGPSQQGVIRQALANAGLTTAEVDVVEAHGTGTTLGDPIEAQAVIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAP

SEQ ID NO: 39 - protein, 339 aa, Streptomyces rapamycinicus
GTVLITGGSGVLAGIAARHLVTERGVRHLLLLSRSAPDEALIGELGELGARVETAACDVSDPAALTQVLAGVSPEHPLTAVIHTAGVVDDGVVESLTVQRLETVLRPKADGAWNLHELTRDADLAAFVMYSSAAGVLGSAGQANYAAANAFLDALAEQRHAEGLPALAVAWGLWEDASGLTAQLTDTDRDRIRRGGLRAISAEHGMGLFDSASRHSEPVLVAAPMEPVRDAEVPALLRSLHRPIARRAAAAGGARWLAALAPAEREKALLKLVCDSAATVLGHADTSTVSVAAVFRDLGVDSLTAVELRNSLAKATGLRLPATLVFDYPTPTALAVRLG

SEQ ID NO: 40 - protein, 341 aa, Streptomyces rapamycinicus
GTILITGGSGVLAGILARHLAAEHGARHLLLLSRTAPDEALIKELAELGARVETAACDVSDRAGLARVLAGVSPEHPLTAVIHTAGALDDGVVESLTTQQLDTVLRPKADGAWHLHELTRDADLAAFVVYSSAAAVLGNEGQGNYAAANAFLDALAEQRRTQGLPALALAWGPWEYTGDLTAQLTGTDQDRIRCSGMRTITAEDGMRLFDTASHHGEPLLVPAVLDPTRDGEVPALLRSLRRPIARRAASADGGVQWLAALAPAEREKALLKLVCDSAAMVLGHADARSIPAAGAFKDLGVDSLMAVELRNGLVKATGLRLPATLVFDYPTPTVLAARLDE

SEQ ID NO: 41 - protein, 342 aa, Streptomyces rapamycinicus
GTVLITGGSGVLAGIAARHLVAERGVRHLLLLSRSAPDEALINQLGELGARVETAACDVSDRAALAQVLAGVSPEHPLTAVIHTAGALDDGVVESLTAQRLDAVLRPKADGAWNLHELTRDADLAAFVMYSSAAGVLGSAGQANYAAANAFVDALAEQRRAEGLPALAVAWGLWEDASGLTADLTDTDRDRIRRGGLRAISAEYGMGLFDSASRHSEPVLVGAAMEPVRDAEVPALLRSLHRPIARRAASTGDSSVQWLAALAPEERAKALLRVVCDSAATVLGHADIDSIPVTAAFKDLGVDSLTAVDLRNSLAKATGLRLPPTLVFDYPTPTALAARLDE

SEQ ID NO: 42 - DNA, 40 bp, Artificial Sequence
  Synthetic
tcatccccttttgctggtaccgatggagctgcacatgaac

SEQ ID NO: 43 - DNA, 40 bp, Artificial Sequence
  Primer
gttcatgtgcagctccatcggtaccagcaaaaggggatga

SEQ ID NO: 44 - DNA, 37 bp, Artificial Sequence
  Primer
gcaaggtcgcgctgatgcggccgctgctggggcaaca

SEQ ID NO: 45 - DNA, 37 bp, Artificial Sequence
  Primer
tgttgccccagcagcggccgcatcagcgcgaccttgc

SEQ ID NO: 46 - DNA, 28 bp, Artificial Sequence
  Primer
gaggggtcgagatgcatccggcggacgg

SEQ ID NO: 47 - DNA, 28 bp, Artificial Sequence
  Primer
ccgtccgccggatgcatctcgacccctc

SEQ ID NO: 48 - DNA, 21 bp, Artificial Sequence
  Primer
ggatcttcgcgagtgtccgtt

SEQ ID NO: 49 - DNA, 37 bp, Artificial Sequence
  Primer
tgtgcagctccatcggtaccgttaactgggacgaagc

SEQ ID NO: 50 - DNA, 29 bp, Artificial Sequence
  Primer
gccccagcagcggccgccgcggaacccct

SEQ ID NO: 51 - DNA, 30 bp, Artificial Sequence
  Primer
cactcgcgaagatcctttgatcttttctac

SEQ ID NO: 52 - DNA, 36 bp, Artificial Sequence
  Primer
gaaccgtccgccggatgcatcttcgcgctccgatgt

SEQ ID NO: 53 - DNA, 32 bp, Artificial Sequence
  Primer
ccgtcgacctgcaggcatgctggcgccggacg

SEQ ID NO: 54 - DNA, 33 bp, Artificial Sequence
  Primer
gccccagcagcggccgcagttgcctgactcccc

SEQ ID NO: 55 - DNA, 39 bp, Artificial Sequence
  Primer
tgtgcagctccatcggtaccactcttcctttttcaatgg

SEQ ID NO: 56 - DNA, 29253 bp, Artificial Sequence
  Synthetic
cgctggatcctaccaaccggcacgattgtccagcccacaacagcatcgcggtgccacgtgtggaccgcgtcggtcagatcctccccgcacctctcgccagccgtcaagatcgaccgcgtgcacctgcgatcgccgatcaaccgcgactagcatcgggcgcaagccgccactcgaacggacactcgcatggacgtccccttcctggacctgcaagccgcgtacctcgaactccggtccgacatcgaccaggcgtgccggcgcgtgctcgggtcgggctggtacctgcacgggccggagaacgaggcgttcgaggcggagttcgccgcctactgcgagaacgcgcactgcgtgacggtcggcagcggatgcgacgcgctggagctgagcctgctggcgctgggcgtcggtcagggcgacgaggtgatcgtgccgtcccacaccttcatcgcgacgtggctcgcggtgtcccgcgtgggcgcggtgccggtgccagtcgaaccggaaggcgtgagccacacgctcgatccggccctggtggaacaggccatcacgccgcggacggccgccatcctgccggtgcacctctacggccaccctgcggacctcgacgcgctgcgagcgatcgccgaccgccacggcctggcactggtggaggacgtcgcacaggcggtcggcgcccgccaccgcggccaccgcgtcggcgccggctcgaacgccgcggccttcagcttctacccgggcaagaacctcggagcgctgggcgacggcggcgcggtcgtcaccaccgacccggccctggccgagcgcatccgcctgctgcgcaactacggctcgaagcagaagtacgtgcacgaggtccgcggcaccaacgcccgcctcgacgaactccaggcggcggtcctgcgcgtcaagctccgccacctcgacgactggaacgcccgccgcacaacgctggcgcagcactaccagacggaactgaaggacgtccccggcatcacgctcccggaaacccacccctgggccgactcagcctggcacctcttcgtcctccgctgcgagaaccgcgaccacctccaacgccacctgaccgacgcgggcgtccagaccctcatccactacccgaccccggtccacctctcacccgcctacgccgacctcggcctgcccccaggctccttccccgttgcggagtctctggcgggggaggtcctcagcctccccatcggcccccacctctccagggaggcggcagaccacgtcatcgcgaccctcaaggctggggcttgatctgcgttcggctcacgcgcagtggaagcacacccgccgcgcaatccgcgcccggtccgctcccgcgttcaccgggatcgcttccccggtcttgatccgctcccaagcgttgggttcgtcgtggatttcgccccactcatcgaagctctccccgtagtggttgcacttcccgggcaggtgggccgtgtccgctcgatacggtcccgcggagatcgacacgtggggagggttcgctagactagaactagaggcatgcccttcgaggagtgcccgcccggaccacgaccgttgacctcgatatgtcagtggtgatcgctgccgtgtgaggtgatcatcactgacgaatcgaggtcgaggaaccgagcgtccgaggaacagaggcgcttatcggttggccgcgagattcctgtcgatcctctcgtgcagcgcgattccgagggaaacggaaacgttgagagactcggtctggctcatcatggggatggaaaccgaggcggaagacgcctcctcgaacaggtcggaaggcccacccttttcgctgccgaacagcaaggccagccgatccggattgtccccgagttccttcacggaaatgtcgccatccgccttgagcgtcatcagctgcataccgctgtcccgaatgaaggcgatggcctcctcgcgaccggagagaacgacgggaagggagaagacgtaacctcggctggccctttggagacgccggtccgcgatgctggtgatgtcactgtcgaccaggatgatccccgacgctccgagcgcgagcgacgtgcgtactatcgcgccgatgttcccgacgatcttcaccccgtcgagaacgacgacgtccccacgccggctcgcgatatcgccgaacctggccgggcgagggacgcgggcgatgccgaatgtcttggccttccgctcccccttgaacaactggttgacgatcgaggagtcgatgaggcggaccggtatgttctgccgcccgcacagatccagcaactcagatggaaaaggactgctgtcgctgccgtagacctcgatgaactccaccccggccgcgatgctgtgcatgaggggctcgacgtcctcgatcaacgttgtctttatgttggatcgcgacggcttggtgacatcgatgatccgctgcaccgcgggatcggacggatttgcgatggtgtccaactcagtcatggtcgtcctaccggctgctgtgttcagtgacgcgattcctggggtgtgacaccctacgcgacgatggcggatggctgccctgaccggcaatcaccaacgcaaggggaagtcgtcgctctctggcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatggaggagatgatcgaggatgccagggcctttcacgcccgccgctgctgagcgtccgccgccgggcccgcaccgccgtcggccggcccgctccgggctcgcagcagcgggcttcggcgcgggcccggggctcccgagcgcgggcggggctccgggcggccgccgggggccgggggcggcgccgggcggcccggggcgtcaggcgccgggggcggtgtccggcggcccccagaggaactgcgccagttcctccggatcggtgaagccggagagatccagcggggtctcctcgaacacctcgaagtcgtgcaggaaggtgaaggcgagcagttcgcgggcgaagtcctcggtccgcttccactgcgccccgtcgagcagcgcggccaggatctcgcggtcgccccggaaggcgttgagatgcagttgcaccaggctgtagcgggagtctcccgcatagacgtcggtgaagtcgacgatcccggtgacctcggtcgcggccaggtccacgaagatgttggtcccgtgcaggtcgccgtggacgaaccggggttcgcggccggccagcagcgtgtccacgtccggcagccagtcctccaggcggtccagcagccggggcgagaggtagccccacccgcggtggtcctcgacggtcgccgcgcggcgttcccgcagcagttccgggaagacctcggaatggggggtgagcacggtgttcccggtcagcggcaccctgtgcagccggccgagcacccggccgagttcgcgggccagggcgagcagcgcgttccggtcggtcgtgccgtccatcgcggaccgccaggtggtgccggtcatccggctcatcaccaggtagggccacggccaggctccggtgccgggccgcagctcgccgcggccgaggaggcggggcaccggcaccggggcgtccgccaggaccgcgtacgcctccgactccgacgcgaggctctccggaccgcaccagtgctcgccgaacagcttgatcaccgggtcgggctcgccgaccagtacggggttggtgctctcgccgggcacccgcagcaccggcggcaccggcagcccgagctcctccagggctcggcgggccagcggctcccagaattcctggtcgttccgcaggctcgcgtaggaatcatccgaatcaatacggtcgagaagtaacagggattcttgtgtcacagcggacctctattcacagggtacgggccggcttaattccgcacggccggtcgcgacacggcctgtccgcaccgcggatcaggcgttgacgatgacgggctggtcggccacgtcggggacgacggggagtcaggcaactattattgaagcatttatcagggttattgtctcatgagcggatacatatttgaatgtatttagaaaaataaacaaataggggttccgcgcacatttccccgaaaagtgccacctgactagcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgcgacgcccctctatggcccgtactgacggacacaccgaagccccggcggcaaccctcagcggatgccccggggcttcacgttttcccaggtcagaagcggttttcgggagtagtgccccaactggggtaacctttgagttctctcagttgggggcgtagggtcgccgacatgacacaaggggttgtgaccggggtggacacgtacgcgggtgcttacgaccgtcagtcgcgcgagcgcgagaactcgagcgcagcaagcccagcgacacagcgtagcgccaacgaagacaaggcggccgaccttcagcgcgaagtcgagcgcgacgggggccggttcaggttcgtcgggcatttcagcgaagcgccgggcacgtcggcgttcgggacggcggagcgcccggagttcgaacgcatcctgaacgaatgccgcgccgggcggctcaacatgatcattgtctatgacgtgtcgcgcttctcgcgcctgaaggtcatggacgcgattccgattgtctcggaattgctcgccctgggcgtgacgattgtttccactcaggaaggcgtcttccggcagggaaacgtcatggacctgattcacctgattatgcggctcgacgcgtcgcacaaagaatcttcgctgaagtcggcgaagattctcgacacgaagaaccttcagcgcgaattgggcgggtacgtcggcgggaaggcgccttacggcttcgagcttgtttcggagacgaaggagatcacgcgcaacggccgaatggtcaatgtcgtcatcaacaagcttgcgcactcgaccactccccttaccggacccttcgagttcgagcccgacgtaatccggtggtggtggcgtgagatcaagacgcacaaacaccttcccttcaagccgggcagtcaagccgccattcacccgggcagcatcacggggctttgtaagcgcatggacgctgacgccgtgccgacccggggcgagacgattgggaagaagaccgcttcaagcgcctgggacccggcaaccgttatgcgaatccttcgggacccgcgtattgcgggcttcgccgctgaggtgatctacaagaagaagccggacggcacgccgaccacgaagattgagggttaccgcattcagcgcgacccgatcacgctccggccggtcgagcttgattgcggaccgatcatcgagcccgctgagtggtatgagcttcaggcgtggttggacggcagggggcgcggcaaggggctttcccgggggcaagccattctgtccgccatggacaagctgtactgcgagtgtggcgccgtcatgacttcgaagcgcggggaagaatcgatcaaggactcttaccgctgccgtcgccggaaggtggtcgacccgtccgcacctgggcagcacgaaggcacgtgcaacgtcagcatggcggcactcgacaagttcgttgcggaacgcatcttcaacaagatcaggcacgccgaaggcgacgaagagacgttggcgcttctgtgggaagccgcccgacgcttcggcaagctcactgaggcgcctgagaagagcggcgaacgggcgaaccttgttgcggagcgcgccgacgccctgaacgcccttgaagagctgtacgaagaccgcgcggcaggcgcgtacgacggacccgttggcaggaagcacttccggaagcaacaggcagcgctgacgctccggcagcaaggggcggaagagcggcttgccgaacttgaagccgccgaagccccgaagcttccccttgaccaatggttccccgaagacgccgacgctgacccgaccggccctaagtcgtggtgggggcgcgcgtcagtagacgacaagcgcgtgttcgtcgggctcttcgtagacaagatcgttgtcacgaagtcgactacgggcagggggcagggaacgcccatcgagaagcgcgcttcgatcacgtgggcgaagccgccgaccgacgacgacgaagacgacgcccaggacggcacggaagacgtagcggcgtagcgagacacccgggaagcctgatctacgtctgtcgagaagtttctgatcgaaaagttcgacagcgtctccgacctgatgcagctctcgcactagtccactgcctctcggtaaaatccagcaaaaattaatcagtgcagctcgctgcactgattaatttttgatcaataggagatcgcttgtgacggcaagcacattgaaatctgttgagtaggcctgttattgtcgcccccaggagacggagaatctcgacgggggcgcagatgagattcaacttattgggacgtgtccatgtaatcaccgatgcgggatgtgtaattccgcttaaatcctcgaaggcgacccagctcctggtgctgctgctcctcaggcggcacgaggtggtgggatcgggggtgctcatcgaggagttgtgggcggaccacccgccccgcagcgccatgacgacgctgcagacgtacgtgtaccacacccgccggctgctgggggagcaccgggtgacgagcgacgaccgggaattggtcctgacccagccgcccggctacttcgccctgatcgacgaggacgaactcgacgtcgcggtcgccgagcgtctgatccgcaccggcggccggctgctcgaggagaaccggctcgaggaggcgctcgcctcgttggacgcgggactggatctctggcgaggcccggcgctgtccaccgtaccgtgcggccgggtgctcgaaagcaatatcgcgcacctggaagagctgcggctttttggaatgcagctccgtatcgacgcgaattggcggctgggcagaatagggccgatgattccggaactccggtccctggtaatttcgcatccgctgaacgagaccctgcacgccaaactgatgggcgcgctctgtcagatgggcaggcgcgccgaggcgctggaatcgtatcggaatctccggcggatactgtccgacgaactgggggtggatccgacgccggaaatccagcgtatgcacatggaaattctcaacggtgagaaggtgctcgtgtagcaccggtccgtgaacgcggtggagcccctcttaagtgttcccctccctgcctcgtggtccctcacgcgctcagctttgggcgcccggctcgagcggcggtcgaagggagatggggtgccgctggacgcggcgccggtggatccggcatcgaggggtcccgtatcggccttcgagcctccttcgagccacggggccgacgatgacgacgaccaccggacgaacgcatcgattactagagtcgaccgctcaagatcgcgacgcgtgttcgccgacgtggaaacgacctgctgcgcgaggagaacgttgaccaccatcgacgaagttcccggcatggccgacgaaaccgcactcctcgactggctgggcacgatgcgcgagaagcagccggtgtggcaggaccggtacggcgtgtggcacgtcttccgccacgccgacgtccagacggtgttgcgcgacaccgccacgttctcctccgacccgacccgcgtcatcgagggcgcgagcccgacgccgggcatgatccacgagatcgacccgccggagcaccgcgccctgcgcaaggtcgtcagcagcgccttcaccccgcgcaccatctccgacctcgaaccccgcatccgcgacgtcacccgctcgctgctggccgatgccggcgagagcttcgacctcgtcgacgtgctcgcgttcccgctgccggtcacgatcgtcgcggagctgctgggcctgccgccgatggaccacgagcagttcggcgactggtcgggtgccctggtcgacatccagatggacgacccgaccgacccggcgctggccgaacggatcgcggatgtgctcaacccgctcaccgcgtacctgaaggcccgctgcgccgagcgccgcgccgatcccggcgacgacctgatctcccgccttgtcctggccgaggtcgacgggcgcgcgctcgacgacgaggaggcggccaacttctccaccgcgctgctgctggccggccacatcaccacgaccgtcctgctcggcaacatcgtgcgcaccctcgacgagcacccggcccactgggacgccgccgccgaggaccccggccggatcccggcgatcgtcgaggaggtcctgcgctaccggccgccgttcccgcagatgcagcgcacgacgaccaaggccaccgaggtcgcgggcgtgcccatcccggccgacgtcatggtcaacacctgggtgctctcggccaaccgcgactccgacgcccacgacgaccccgaccggttcgacccgtcgcgcaagtccggcggcgccgcgcagctctccttcggccacggcgtgcacttctgcctcggcgcgcccctggcccggctggagaaccgcgtggcgctggaggagatcatcgcccggttcgggcggctcaccgtcgaccgcgacgacgagcgcctgcgccacttcgaacagatcgtgctcgggacccgtcacctgccggtgctggcgggctcctcgccgaggcagtcggcgtagtcgggcagcatccctcgccgcctggcggtctccaggtccacggccaccgtgtcgcggtcggagagcacgacctccaggtccgcgggccacggcagacccagcgcggggtcgaacgggtcgatcgcctgctcgtactcggccacgtacggcgtgctgaccaggtacgacatcagggtgtcgtcctcaagcgcgaggaaggcgtgcgcggtgcccctggggaagtagaccgcccggaagtgctcggtgtccatctccaccgcgtcccacttcccgaacgtcggcgagccgacccggatgtcgacgatgacgtcgagcgcccggccgcgcgcgcagtagacgtacttgcactgccccggcggggtggtggtgaagtgcagcccgcgcagcacgccccgggcggagacgatgtggttcatctgggcgacggggaaccgatggcccaccgcgcccacgaacgcctcgtcctgcagcggagacacgaacaggccccgccggtcctgcttcgggtcgggggtgaactcgaaaccgcccgccaccgccagctcacgtactcgcaactccggttcaccttccgcgcaggaagccgcggtggtcctcccacccgtcggcgatgtctcgttcgagctggttgagccgtgcggtcaccgactggtcgaagccgtcgaggaagtactcgtcgccggggcggggctgcacgccctcgttctccagcacgaagttctccaccacctcgcgcaggctggtcgacggggtgacccggcccgcgatgtagcgggtggcgccctccagctccgggaagcccgcctcgcggtagaggtagacgtcgccgagcaggtcgatctgcaccgcgacctgggggtgcgcggtgggacgcatcgtctccggccggatgcgcagcagctcggcgtccacaccccgccgcaggctctccagggcgtagcccaggtcgatgtgcatgcccggggtccgctcggcggcgtagtcgacgaaccgcaccaggccctcgcgcagctcgttgcgctcggagtccgacagccggccgtcgtcgcggccgctgtagtcctcgcgcaccgtcacgaagtccagcggccgttgcgggctggactcgttgagctcggcgatgaagtcgacgaggtcggtgagccggtcggcccgtcccggcaggatgatgtggttgaagccgagccggatcggcgcgtcccgctcggcgcgcatccgcaggaagccctgcaggttcttcttgacgcgttcgaaagcgccgcgcttgccggtggtcgtctcgtactcgtcgttgttcagcccgtagagggacgtgcggatcgcgcccagctcccacaggccgggctggcggttcagcgtctgctcggtgagggcgaaggcgttggtgtagacggtgaggtcgaaaccgcgcccggcggcgtgcgacaccagctcgccgagaccggggttggtcagcggctcgagcccgcccgacatgtacatcgccttcgggttgtccgtgggcacctcgtcgatgatcgcggccagcgtctcgttgcccgccgggaccgatgcggcctcgtagcgggcaccggtcacccgcacgcagaagtggcagcggaacatgcacgtcggcccggggtacaggccgacgctgtaggggaaggcaggcttgcggtagaccgccgcgtccagtgcgcctgcggcgtccagcggcttgatcgtgttggaccagtacttgcccgccggaccgtgctccaccgcggtgcccaggtccgggatgcggccgaacaggtcgagcaggtgggcgaactccgcgcggtccaggccgagccgcgcacgcgtctgctccagcggcgtgaacgggtgcgccccgtagtgcgcggcgaggtcggcgagccgggcggcctgcacgtcggcgtcaccgtcaccggcgccggtgacgcgggagacctccgagctcagcgcccgcacgaccgcccgccggtcgacgtccgggcgcgccgcgtcggcgacccccgcttcctgggcggttgccgtacgagttgtgttcatcggggagcgaacctcctggcacttgtggcgcaggtcgtcacgaaccgttgcgcgtcctctggtcccattgcgcgttgatcagctcgccgctggtggcggcgagccggatgatgtcgcacacccgccggatgtcctcgctggacaccgcggggccggtgggcagcgcgagcacccggtcggagagctgttcggtgttctccagccgcagcggcggctcggtccggtacggctgcatctggtggcacccgggggagaagtagggttgtgccacaaccttctccgctcgcaggatcgcctgcaactggtcgcggtcgatgccggtggccgcggagtccaccgagatgatcacgtactggtagttgttctgctcgccaggatcgaacgcgtgcacggatatgccgcgcacgtcgcggagctcgtcggagtagagcgcgtggttgaggcggttgtgcaccctggtctcggcgaaggcgtcgagcgaggtgaggcccatcgccgcggcgcactcgctcatcttgccgttggtgccgacatcggtcaccagcttgtccggtgcgatcccgaagttgtgcatggcgcggatgcggtcggccagcagcccgtcgtcggtgacgatggcgccgccctcgaacgaggtgaccgccttcgtggcgtggaagctgaacacctcggcgttgccgaaggcgccgaccggccgcccgccggcggtgcagcccagcgcgtgcgcggcgtcgaagaagagtttgacctggtgctcggcggcgatcttctccagcgcctcgaccggagcgggcctgccccacaggtgcacgccgatgatcgcgcccgtccgcggtgtcaccagcgacgcgacgtgctcggggtcgagcaggccggtctcggggtccacgtcgcagaacaccggttccagccccagccagctcgccgcgtgcgcggtggccgcgaacgtcatcgaaggcatgacgacctcgccggacacgtcgctcgcgcgcagcaccagttgcagcgcgaccgtcgcgttgcaggtggccacgcagtggcggacacccgccaggtcggcgacccggccctcgaactcgcgcaccagtggtccgccgttggtcagccagttgttgttcagcgcccactccaggcgggcgaagaaccgctcccggtccccgacggtcggcctgcccacgtagagggtgtgcaggaatgcctcggggccgccgaagatcgccaggtcggtcagcgcgcgtttcatccggcggtcctggtgtagacggccgaggcgcacgcgatgatgctgcgcagctggatgttgacgtagtggctgtgcccgagcaggtaggtgatctggtcgaaggtcatccaccggtggtcgggagcggcactggcgtcgaagtcggcgggcacctcgatcagcatgtaccggttctcgttgcggtagaaccggccgccctcctcggagtgccatgcgtcgtagcggacctgcgagcgcggcacgttcaacacgtagtccacataggccggtcggaactcctcgggcgcgtcggcgtagttgtcgggctggcagtgcaccgtaggcgccagctcggcgacgtccatcccgcccgcctcggtgcgcagctgcacgagcgcgtgcaacgtgccgccgatgtccttgaccagcagggcgagcaggccgttgttggcgggcgagagcagcggctgcatccacgagttgacctcgcggtcgctggtcgccaccgtgacgccgaagacgtcgaagtacttcttctcctcgtgctcgatgccgtcgtcgcggcggatccacccgctgcgctcgatgtcgggcagcgggcggccgcgctgcacgaactcgcgcctggcgcgcacgtcggagatccagctcagcaggctgttcatgttgttggccggggtgcccgcgccgatgaacgagtgcagcagccgggcctggaacgagccctcgggcaggcgcgcgagcacgtcgtcggcccggtcccgctccacggcggtcgggacgcaggccagcacggtgcgcaggtccatgttcaccacgttgtcgtggtgcagcatcgcccgcagctgcgcgacggtcagccaccggaagttcgggtgctcgggcaggtcgtcgaacacctcgacgaccatgttccggttgcgcttgcgcaggaaccacgcgccctgctcggactggagcacgtcgacgaggatccggctcgggcgcgtgccgttgaagtactcgatgaaccggaccttcgagccgcggtggacgccggtgtagttgctgcgggtcgcctgcagggtcggggagagctggacggcgttgatgttgcccggctcggccttggcctgcgccagcacgtgcagcacaccgtcgaactccttgacgatgaggccgaggaagccgatctcgggctgcacgatgatgggctggatccagtcccgccgccagccgaagttcgtccgcacgtgcaggccctcgatggagaagaagcgcccggactcgtgggcgagcctgccgtcctcgggctggaacgaccagcggtccatggcgctgaacggcacgcgcgccacctcgagccgctgctcggcgccgttgcgggtcagccagtcgtgggtttccgccgtggcggtggggattccgccgtcgccgagcaggaaacgcgttgcggtctgcgaggattccggaatcgtccggtcgccggtccgatcacccattctagcgactctccctgcggtgtcgtcgacggctccgcttgctgccgccgggcgttgtcgatcaagacccgcactcactgtaagggtccggtcacggcggggaaagggcccgtggagcggatcacctgtgccaggaacggaaaacgcgaacgcacgggtcatccgcgcacaccgacgaacaacccgcgtccggagggtccgccctccaggtactgcacagcgcaaccggccgcggtgaaggccttctcgtactgctgccgctcgaagagcgtgatctcgtagtgctccacgtggtgccgcggaccgttcaccgcgtcggccacgacccagtggatctccatccgggtcgcgccgccggcgcgcacggagtgcgagacgcgcgagatcgtcaggtcgccgtcgcgcaccacgtcaccggccacgtagccgtcgaggaagtcctccgggaaccaccacggttcgaccaccacgacgccgccgggggcgaggtggcgggcgaaggacgccagcgcctggtccagctcggcgccgtcgcgcatgtgcccgatggagctgaacatgcaggtgacggcgtcgaactcgcgatccagcgcgaagtcgcgcatgtcgccctgcagcaccgggatgccgccgagctgcggccgggcgacctcgatcatcgccgccgacagctccagcccggtcacgtcgtcgaagaggtcggcgaaccggcgcaggtgggtgccggtcccgcaggccacgtcgagcagcgaggaagccgagggcaggcggtctctgaccagccgcgcgacctgcgcggcctcggccgcgtagtccttgccccggccgcggtagaaccggtcgtaaagctcggcgaacccgccctcgtacatccctgctccctccggaggtgtgctgtcggacggacttgtcggtcggaaaccgctagccggcgtggcggcgcgtgagttcctccagtcgcgggacgatctcctgcggcgtcgggtcggacagcgcctcctcgcgaagcttcaccgcgttctcggtgtaggtggggtcctcgaccacctgggtgagggcgctcgccaatgagtcggcatcgacctcgtccggccggaggtagattcccgcgcccagttccgcggtctgctggccgcgtagcatgcaatcccattcatgtgcaactgatatttgcggaattccgtggtgcagtgccgtggcccaggttccggccccgccgtggtggatgatcgccgcgcagttctggagcagaacgcccatcggaacgaaatccaccaaacgaatgttgtccggtaccgcggaggtatccggaccggaacccgtaaccacgatttcgccatcgaatcgcgcgagctgcgcgagcgtccgcgcgaactgatcggcatcggcggcgagcccgagtccggagaaccctccggtaatgcagatgcgtcgagtcgcactgcccttcttgagccagtccggaaccaccgacgcgccgttgtagggcagggtccgcgcgacaacggtttccattccggtgtccagccggaaactcggcggcaactggtcgaccgaccactgcccgaccgcgaggtcctcgccgaattcgacgccgaagcgccccgcgacctcggtcagccacgtgcccagcgggtccggccggtcctccggcggccgtcgcaggcgttgcgcctggaaccggccgcggaagtagccggtgaggtcgctgccccacagcagccgggcgtgcgcggctccgcaggcccgggccgcgacggcgccggcgaaggtgaacggctcccagagcaccaggtcaggacgccagtcccgggcgaagtcgaccagctcggcgacgaaggagtcgttgttgaccaccgggtatacccaccgcgaggtggcctcctgcatgccgagcaggaactcccacgagtgcagctcctgctcgcggtggtagaagtccaggtagaaggagtagcggtgcacctgagcggcgacttccgggacgatgtcgaacagccggtggtcggagccgacgggtaccgcggtgagaccggcgccgatgaccgcgtcggtgagcgcgggctgggcggccacgcgcacgtcgtgacccgcggtgcgcagcgcccacgccagcgggaccagtccctggaagtgcgtgcggtgcgcgaaggacgtcagcagtacccgcactagtgctcctcggtgggggtcagggcggccaccgtccggtcgatgccgtcggtgagggaaacccgggggcgccagccggtccggctgcggaactcggtggagtcgatgtcgtcgctgcggaagtcgttggcctcggcgtgctcgggcgcgggcacggtgaccacgtcgacggcggggctgccggtctgccgggcgacgctgccggagacggcccggaagatgtcgccgagcggctcggatcggtcggcgcccagcgcccacgtgccgccggccagcgcgtcgtggtgctccagcgcggcggcgaacgcggtggccacgtcctcgacgtgcagcaggtcgcggcgcacgccgccgtcgtgccacatggtgagcggctcgccggcgagggcacgccggatcatcgctgcgaccacgccccgccccatggggccggacgggccgctctggccgtagacggcgggcagccgcaggatcacgccgcgcacccggccctcgtcggtggctttgcgcaggatgcgctcggcctcggtcttctgctgcgcgtacctgctggccgccgacgggttcgcggcctgtgcggtgctcgcgtagagcaacacgggcggcgtcgacctgcggcgatcgtgcagcgcgccgacgaggtcgtgcatcaggccgacgttgacccgctcggcttccgggtcggaggtggcgctgcgccaggtggaaccgcccgctgcgtgcgccaccaggtgcacgatcacgtcggcgtcctcgatcgcggcggcggcccggcccggttccagcaggtcggcgcgcaggtcctcgacctccgcggcgccgggcggaaccgcgggcgctccgccgcgggacaccgcgcgcagccggaccgggtggtcgcgcagctcgcgcagaaccgcgctcccgacgaagccggaagcgcccagaagggtgatcaattgacgcggggaatcactgatcccattcaccggagcatttgctcgctttccaggtcggtgctacgggcgaaattcaaagaatctccccagcgcgatgtgcggcaacccgtcactgggccaccacagtaggtagccgccgttgatcttgtcaacatgcagatgttcacaggttcgttggctcgacgaggcgatgtcaacctcttgatccttcctatattgttcgcccattgcgtggtcgtcgagtagggggacgctggagggaattcatgaccacgaccgatcgcgccgggctgggcaggcagctccagatgatccgcggcctgcactggggttacggcagcaacggcgacccttacccgatgctgctgtgcggacacgacgacgacccgcagcgccggtaccgctcgatgcgcgagtccggtgtgcggcgcagccgcaccgagacgtgggtggtggccgaccacgccaccgcccggcaggtgctcgacgaccccgcgttcacccgcgccaccggacgcacaccggaatggatgcgggccgcgggcgcgccacccgccgagtgggcccagccgttccgggacgtgcacgccgcgtcctgggaaggcgaggtccccgacgtcggggaactggcggagagcttcgccggtctgctccccggcgcgggcgcgcggctggacctggtcggcgacttcgcctggcaggtaccggtgcagggcatgaccgccgtgctcggcgcagccggagtgctgcgcggcgccgcgtgggacgcccgcgtcagcctggacgcccagctcagcccgcagcagctcgcggtgaccgaagcagcggtcgcggcactgcccgccgaccccgcactgcgcgccctgttcgccggggccgagatgaccgcgaacaccgtggtcgacgcggtcctggccgtctcggccgaaccggggctggccgaacggatcgccgacgaccccgccgccgcgcagcgaaccgtcgccgaggtgctgcgcctgcacccggcattgcacctggagcggcgcacggccaccgcagaggtgcggctcggcgagcacgtgatcggcgaaggcgaggaggtcgtggtcgtcgtcgcggcggccaaccgcgacccggaggtcttcgccgagcccgaccgcctcgacgtggaccgccccgacgccgaccgcgcgctgtcggcacatcgcggccaccccggcaggctggaggagctggtcaccgcgctcgccaccgccgcactgcgggccgcggccaaggcgctgcccggactcacgcccagcggcccggtcgtccggcgccgccgatcacccgtcctgcggggaaccaaccgctgccccgtcgagctctgaggtaaccgcgatgcgcgtcgtcttctcctccatggccagcaagagccacctcttcggcctcgtccccctcgcatgggcgttccgcgcggcggggcacgaggtccgcgtggtcgcgtccccggcgctcaccgaggacatcaccgcggccgggctgaccgccgtcccggtcggcaccgacgtcgacctcgtggacttcatgacccacgcgggccacgacatcatcgactacgtccggagcctggacttcagcgagcgggaccccgccaccttgacctgggagcacctgctgggcatgcagaccgtgctcaccccgaccttctacgccctgatgagcccggacacgctcatcgaaggcatggtctcgttctgccggaagtggcggcccgacctggtcatctgggagccgctcaccttcgccgcgcccatcgcggcggcggtgaccggaacgccgcacgcgcggctgctgtggggacccgacatcaccacccgggcgcggcagaacttcctcggcctgctgcccgaccagccggaggagcaccgggaggacccgctcgccgagtggctcacctggacgctggagaagtacggcggcccggccttcgacgaggaggtggtcgtcgggcagtggacgatcgaccccgccccggccgcgatcaggctcgacaccggcctgaagaccgtcgggatgcgctacgtcgactacaacgggccgtccgtggtgccggaatggctgcacgacgagcccgagcgccgccgcgtgtgcctcacgctcgggatctccagccgcgagaacagcatcgggcaggtctccatcgaggagctgctgggtgccgtcggcgacgtcgacgccgagatcatcgcgaccttcgacgcgcagcagctagaaggcgtcgcgaacatcccggacaacgtccgcacggtcggcttcgtcccgatgcacgcgctgctgccgacctgcgcggcgacggtgcaccacggcggacccgggagctggcacaccgcggcgatccacggcgtgccgcaggtgatcctgcccgacggctgggacaccggcgtgcgcgcgcagcgcacgcaggaattcggggcggggatcgcgctgcccgtgcccgagctgacccccgaccagctccgggagtcggtgaagcgggtcctcgacgacccggcccaccgcgccggcgcggcgcggatgcgcgacgacatgctcgcggagccgtcaccggccgaggtcgtcggcatctgcgaggaactggccgcaggaaggagagaaccacgatgaccaccgacgccgcgacgcacgtgcggctcgggcgttccgcgctgctcaccagcaggctctggctcggcacggtgaacttcagcggacgcgtcgaggacgacgacgcgctgcgcctgatggaccacgcccgggaccgcggcatcaactgcctcgacaccgccgacatgtacggctggcggctctacaagggccacaccgaggagctggtgggcaggtggctggcccagggcggcggacggcgcgaggacaccgtgctggcgaccaaggtcggcggcgagatgagcgagcgcgtcaacgacagcgggctgtcggcgcggcacatcatcgcctcctgcgagggatcgctgcgcaggctgggcgtcgaccacatcgacgtctaccagatgcaccacatcgaccggtccgcgccgtgggacgaggtgtggcaggccatggacagcctcgtcgccagcggcaaggtctcctacgtcggctcgtcgaacttcgcgggctggcacatcgccgccgcgcaggagaacgccgcccgccgccactccctgggcatggtctcccaccagtgcctgtacaacctggcggtccggcacgccgagctggaggtgctgcccgccgcgcaggcctacgggctcggcgtcttcgcctggtcgccgctgcacggcggcctgctcagcggagcgctggagaagctggccgcgggcaccgcggtgaagtcggcgcagggccgtgcgcaggtgctgttgccgtccctgcgcccggcgatcgaggcctacgagaagttctgccgcaacctcggcgaagacccggccgaggtggggctcgcatgggtgctgtcccggcccggcatcgccggcgccgtcatcggcccgcgaacccccgagcagctcgactccgcgctgaaggcgtccgcgatgaccctggacgagcaggcgctgtccgaactggacgagatcttccccgcggtggcctccggcggcgcggcgccggaagcctggttgcagtgagcacaagaggaaccgagaaaggatacggctggtgagcgtgaagcagaagtcagcgttgcaggacctggtcgacttcgccaagtggcacgtgtggaccagggtgcggccgtccagccgtgcgcgcctggcctacgagctgttcgccgacgaccacgaggccacgaccgagggcgcctacatcaacctcggctactggaagcccgggtgcgccggcctggaggaggccaaccaggagctggcgaaccagctcgccgaggccgcggggatcagcgagggcgacgaggtgctcgacgtcgggttcgggctcggcgcgcaggacttcttctggctcgagacgcgcaagccggccaggatcgtcggcgtcgacctgaccccgagccacgtccgcatcgcctccgagcgcgcggagcgcgagaacgtgcaggaccgcctgcagttcaaggagggctcggcgaccgacctgcccttcggcgcggagaccttcgaccgcgtcacctccctggagtcggccctgcactacgagccgcggaccgacttcttcaagggcgcgttcgaggtgctcaagcccggaggcgtgctggccatcggcgacatcatcccgctcgacctgcgcgagcccggttccgacggaccgccgaagctggcgccgcagcggtcgggatcgctgtccggcggcatcccggtggagaactgggtgccccgcgagacctacgccaagcagctccgcgaagcgggcttcgtcgacgtcgaggtgaagtcggtccgcgacaacgtgatggagccctggctggactactggctgcgcaagctgcaggacgagtcgttcaagaagagcgtgagcaggctcttctacagccaggtcaagcggtcgctgaccagcgactcgggcatgaagggcgagctgcccgcgctcgacttcgtgatcgcctcagcccgcaagcccggcgcgtagcaggtcccggcgcacggcaccggccacctcggtgacctgttcacccaggtagaagtgcccgccggggaaggtcctggtccggccggggatgaccgagtgctgcaaccagcgctcggcgtccccggtcgcggtcagcgggtcggcgtcgccgcacagcgcggtgatgccggcccgcagcggtggtccgtccgcccaggcgtaggagcgcagcacgcggtagtcggcgcgcagcaccggcagcgacatggcgagcagggcctcgtcggccagcgccgcctcgctggtgccgagccggcgcagctcgtccaccagaccgtcgtcgccgggcaggtcggtgcggcgctcgtgcacgcgcggggcggtctgcccggacacgaacagccgcagcggcccgccgccgggctcgcgttcgagcctgcgcgccgtctcgtaggcgatcaacgcgcccatgctgtgcccgaacagggcgaacgggccgtcgccgcccgacgcgcgcagcacggcggccacctcgtcggcgatctcgccggcggtgcccaggggctcctcgtcgcggcggtcctggcgccccgggtactgcacggcgtgcacgtcgatctcgggcgccaaggcgcgcgcgaggtcgaggtaggagtcggccgcggctcccgcgtgcgggaagcacaccagccgcgcccggtgctcgacgggaggaccgaaccgccgcagccaggtgctcatgaattccctcctctagtcatccgtcgagccgcaccggtaggtggtcgatgccccgcagcagcagcgaacgccgccacaccacgtcgtcggcgtcgattcccagcgacagagcggggaagcggccgaacagcgcccgcagcgccacctcgccctccagcttggccagcggccggcccatgcagaagtggatgccctgcccgaacgacaggtggccgcgggtgtcgcgggtgacgtcgaagcggtgggggtccgggaactgcttcgggtcgcggttggccgcgccgttcgcgaccagcaccgtgctgtactgggggatcgcgacaccgccgatctccacctcctccgcggcgaagcgcgtggtggtctccggcggagcgatgtagcgcaggatctcctcgacggcgttgggcagcgccgacgggtcccgccgcaccagcgcgagctggtccgggtgggtgagcagcaggtaggtgccgatcccgatgaggctcaccgacgcctcgaaaccggccagcagcagcaccagcgcgatggaggtcagctcgtcggcgctgagccgaccgtcatcgtcgtcctggaccctgatcagcgcggacagcaggtcgtcgccgggctcggtgcggcggcgctcgaccaggtcgaggatgaagttgacgacctccctggccgcctgcccgcgctgttcggcccgctccgggtccatgaccaggatctccgagctccaccgcccgaactccccgcggtacttctcgtcgacgccgagcagctcgcagatgaccttgatgggcagcgggtgggcgaagcggtcgacgatgtcgaccacgccggagtcgcccacctcgtcgagcagctccgcggtgatctgctcgacgcggggccgcatcgcctccacgcggcggacggtgaactcctgcgacaccagcttgcgcagccgggtgtgggtcggcgggtcgctggtgcccatgttggtggcgaagtagttccgcacgtcctcggggaaaccgaggtatgccgggaactcgacctccacgcccgggtacttcttcttcgggtcgctgctcaggcgcaggtcgctcagcgcggccttcgcctcgtcgtagccggtgaccagccacgcgtcctggccgaggaagcgcaccggcgtcaccggcgcggtctcgcgcagctcggcgtaggtgcggtaccagtcgacgtggaaggagtcgctttcgagatcgggaacggtcgtcatacgacttccagtcggggtagggggaagatcagctttccgccgccagcgaggaactcctgctcgcgttcgacgaacccgtcgcggtagatccagggcagcaccagcagctggtcggggcggcgcgacttggcctcttcctccgacacgatcgggatcccggtgcccggggtgtagcaaccggacttctccgggctgacctcgccgatgcagggcaggtcctgctcggtgagcccgcagtactggaggatgacgttgcccttggtcgaggcgccgtagccgagcgtcagcttgccctcggcgcgggacttggccaggaactccagcagttggtcgcgctggcgctcggtttcgcgcgcgaacgcctcgtagggggccatggtgtcgagcttcgcggcggcctcgcgggcgcggatgcgctccaggcccgcctcgtcgaccgggtggccgctgccttgcttggccagcacggcgcacaggctgccgccgtagacgtcggtgatctcggcgtcgacgaccttcagcccgacccgctgcgccatccactcgatctgcgcgagcgcgtagtactcgaggtgctcgtggcacacgacgtcgtaggcgccggcgtcgagcatggagggcaggtagctctgctccatcagccagagcccgtcgtcggccaggatgtcgtgcacgtcccgcatgaaccgcatcggctcgggcaggtcgtagaacatcgcgatggaggtgacgacctttgcgcggcgctcgccgtagcgctcctcgaaggcgtcggccgagaagaacccggtgaccaggtcggcctccggcgggtagaggtcgcggaacttctcgcccaccaggtcgaagccggccagcttcggggcgtcgggcaggtatccgcgcagcagcgtggagtcgttgctgccgatgtcgaccaccaggtcgtccgggcccaccggcaccatgccccgcagcttggccaccttgccgtgcaggtggttgatcatgaacgggcggatgccggaccggtagccgtatccctcgttgtacatcagcccgaaatcggcgctctcgcgcagctggaccagtccgcagccgggcggcgcgcacttgaccagttcgagcgggaccgagggcacgatttcgtcgcggttccgggggaacactccggtgagggcctgatctcccaggtgcagcacggactcgaggtcatggttcccgcatatgcggcatttgcctagtcccacaaggaagatcataacgagcgcggcgccgcggccaacccgtcgagctttgtgtcctggatcacatcagccggtttacgactcccgttgcgtccattgtggatcgcgctttccgctgcgatgtccggccgaggagcggcgtccgaaaagtccgtgtcggcaccgcgcgccggtgttaggttgatcaagctgaaaattgtttgcatgactgggggtgagcgcgtgaaacggctggtcatccgcatcgcgccgctgttgttggtagttccgctgctcgtggcggccgtatcgccggtacgccattcgcagcgggtggatgagctgatcggacagctgaccctggacgagaagctctccttcgtctactgggactacaacgagaaggacccgctggcgaagctctggctgcccggagtaccgcgcctgggcatcccgcagatccgcggcaccgacgggcccgccggggtcaccatccaccagccggcgatcgccatgcccgcgccggtcgcgctggcgtcggcgttcgacgaccggctggcccacgagtacggcacggtgctcggcagggagggccgcgcgttcgagcaggacatcatcctgggcccgatggtcaacaacatccgcgtcccgcaggcgggacgcaacttcgagaccttcagcgaggacccgctggtcaccgcccgcaccgcggccgcccagatccgcggcatccacagccaggggctgatgaccagcgccaagcactacgcggccaacacccaggagaccgaccggttcaccatcgacgtcgacgtggaccagcgcaccctgcgggagctggagctgcccggcttcgaggccgcggtcgccgccggcgcgacatcggtgatgtgcgcctaccccaaggtcaacggcacgcacgcctgcggccaccggcagctgctcaccgagatcctcaaggagcagtggggtttcaagggctgggtgatgtcggactggaccgccacccacgccaccgaggacctcgtcgccgggctcgaccaggagatgggcgtcgaggtccgcgaggacggcagcctgttcaggggcaagtacctgggcgaggcgctgaagaaggccatccgggagggccgcattcccgagtccgcgctcgacgcgtcggtgcgccgcatcctcacccagttcgagcggttcggcctgctcgacgagaccaagccgccgcggccggagcgcgacgtcgcgggcggcacccgcatcgcccaggaggtcgccgagtcgggcgcggtgctgctgcgcaacgagggcggcgtgctgccgctggatcccgcggcgggccaggacatcgcggtcatcgggccgtcggcccaacagccgaaggtcaccgggctgggcagctcctacgtcgagcccgacttcgccaacgcgccgctggacaccatcacccagcgcgtcggcagcggcggtcgcgtcgggtactccgtcggcgaggagctgaagggcgctccgatcccggaaaccgcgctgcaaccggcgttcgtgcccggcgaggtcacgccgcccccatcaggcggcgtgatctacgacggcaggctgaaggtggacgccgacgggctctaccgcatcgcggccaggatcgacggaggcaacgggagcctgcagatcgacggcggcgccccgatcggcgtcggcgacgtcttcggcccgctcaccagcgtgccggtctggctcaccaagggcgagcacaccatccagatgaccggagcggcgccggtgggcggcggttcgctcgacgtcgacctgacctgggtcaccccggggcacgcccagcgcgagttcgacgcggcggtggagcgggcgcgcgactccgacgtcgcggtggttttcgcctacgacgacggcgcggagaccgccgaccgcacgtcgctgagcctgcccggcacccaggacaagctgatcgacgccgtcgcctcggtcaacccgaacaccgtcgtggtgctcaacaccggctcgtcggtcacgatgccgtggctggacaagacccgcgcggtgctcgacatgtggtacccgggacaggccggggcggaggccaccacggcgctgctgttcggcgacgccgagcccggcggccggctcacccagaccttcccggtgtcgcaggaacgcacgcccgtcggcggcgacccggcgcgcttccccggcgtggacgggaaggtgcactactcggagggcatcttctcgggctaccgctggtacgaccgggagggtgtggacccgcttttcccgttcgggcacgggctttcctacaccacgttcgagcgcaccgacccggtcgtcgagcgcacccgcgacggcctcgacgtgacggtgaccgtgcgcaacaccggtcagcggcgcggcagcgacgtcgtgcaggtctacctcggccccagcccgcaggttccgctggaccaggcaccgcggcagctcgccgggtaccagaaggtcgaactcgcaccgggcgagaccaagcgcgtccgggtgcacgtcgcggagcgggccctccagcactgggacgaagccgcgggcggctggaagctcgggggcggcaagcgagcggtggagatcggctcgtcgtcgcgcgacatcgacctccgggccgacatcaacctctgattcctctcgaccaacaggccgctcgacggcctgccccgttccgcgtgccggggatctag

SEQ ID NO: 57 - DNA, 36 bp, Artificial Sequence
  Primer
tgtgcagctccatcggtacccatgcccgttccatac

SEQ ID NO: 58 - DNA, 36 bp, Artificial Sequence
  Primer
gccccagcagcggccgcagctttatgcttgtaaacc

SEQ ID NO: 59 - DNA, 2007 bp, Artificial Sequence
  Synthetic
ctcaagaagatcctttgatcttttctacggggtctgacgctcagtggaacgaaaactcacgttaagggattttggtcatgagattatcaaaaaggatcttcacctagatccttttggttcatgtgcagctccatcggtacccatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggataccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgaaaggctggctttttcttgttatcgcaatagttggcgaagtaatcgcaacatccgcattaaaatctagcgagggctttactaagctgatccggtggatgaccttttgaatgacctttaatagattatattactaattaattggggaccctagaggtccccttttttattttaaaaattttttcacaaaacggtttacaagcataaagctgcggccgctgctggggcaacacgtggagcggatcggggattgtctttcttcagctcgctgatgatatgctgacgctcaatgccgtttggcctccgactaacgaaaatcccgcattt

SEQ ID NO: 60 - DNA, 35 bp, Artificial Sequence
  Primer
gaaccgtccgccggatgcatgtaagcgtcacggca

SEQ ID NO: 61 - DNA, 36 bp, Artificial Sequence
  Primer
ccgtcgacctgcaggcatgccgctaggaacagttgc

SEQ ID NO: 62 - DNA, 1563 bp, Artificial Sequence
  Synthetic
aatcgttagttaggctaactagtcatgcgagtgtccgttcgagtggcggcttgcgcccgatgctagtcgcggttgatcggcgatcgcaggagcacgcggtcgatcttgacggctggcgagaggtgcggggaggatctgaccgacgcggtccacacgtggcaccgcgatgctgttgtgggcacaatcgtgccggttggtaggatccacatatgcagggttctgtgacagagtttctaaaaccgcgcctggttgatatcgagcaagtgagttcgacgcacgccaaggtgacccttgagcctttagagcgtggctttggccatactctgggtaacgcactgcgccgtattctgctctcatcgatgccgggttgcgcggtgaccgaggttgagattgatggtgtactacatgagtacagcaccaaagaaggcgttcaggaagatatcctggaaatcctgctcaacctgaaagggctggcggtgagagttcagggcaaagatgaagttattcttaccttgaataaatctggcattggccctgtgactgcagccgatatcacccacgacggtgatgtcgaaatcgtcaagccgcagcacgtgatctgccacctgaccgatgagaacgcgtctattagcatgcgtatcaaagttcagcgcggtcgtggttatgtgccggcttctacccgagttcattcggaagaagatgagcgcccaatcggccgtctgctggtcgacgcatgctacagccctgtggagcgtattgcctacaatgttgaagcagcgcgtgtagaacagcgtaccgacctggacaagctggtcatcgaaatggaaaccaacggcacaatcgatcctgaagaggcgattcgtcgtgcggcaaccattctggctgaacaactggaagctttcgttgacttacgtgatgtacgtcagcctgaagtgaaagaagagaaaccagagatgggcgtccaggtcgaaaccatctccccgggcgacggccgcaccttcccgaagcgcggccagacctgcgtcgtccactacaccggcatgctggaggacggcaagaagttcgactcctcccgcgaccgcaacaagccgttcaagttcatgctgggcaagcaggaggtcatccgcggctgggaggagggcgtcgcccagatgtccgtcggccagcgcgccaagctgaccatctccccggactacgcctacggcgccaccggccacccgggcatcatcccgccgcacgccaccctggtcttcgacgtcgagctgctgaagctggaggcggccgcatcgaattcccggggatcctcgagttaattaattaattaagatcttaggcgcgccggatctgtctagaccagatctcatcaccatcaccatcactaagcttaattagctgagcttggactcctgttgatagatccagtaatgacctcagaactccatctggatttgttcagaacgctcggttgccgccgggcgttttttattggtgagaatccaagctagaaatctgcattaatgaatcggccaacgcgcggggagaggcggtttgcgtattgggcgc

SEQ ID NO: 63 - DNA, 1437 bp, Artificial Sequence
  Synthetic
ttagttaggctaactagtcatgcgagtgtccgttcgagtggcggcttgcgcccgatgctagtcgcggttgatcggcgatcgcaggagcacgcggtcgatcttgacggctggcgagaggtgcggggaggatctgaccgacgcggtccacacgtggcaccgcgatgctgttgtgggcacaatcgtgccggttggtaggatccacatatgagcacaaaaaagaaaccattaacacaagagcagcttgaggacgcacgtcgccttaaagcaatttatgaaaaaaagaaaaatgaacttggcttatcccaggaatctgtcgcagacaagatggggatggggcagtcaggcgttggtgctttatttaatggcatcaatgcattaaatgcttataacgccgcattgcttgcaaaaattctcaaagttagcgttgaagaatttagcccttcaatcgccagagaaatctacgagatgtatgaagcggttagtatgcagccgtcacttagaagtgagtatgagtaccctgttttttctcatgttcaggcagggatgttctcacctgagcttagaacctttaccaaaggtgatgcggagagatgggtaagcacaaccaaaaaagccagtgattctgcattctggcttgaggttgaaggtaattccatgaccgcaccaacaggctccaagccaagctttcctgacggaatgttaattctcgttgaccctgagcaggctgttgagccaggtgatttctgcatagccagacttgggggtgatgagtttaccttcaagaaactgatcagggatagcggtcaggtgtttttacaaccactaaacccacagtacccaatgatcccatgcaatgagagttgttccgttgtggggaaagttatcgctagtcagtggcctgaagagacgtttggcatcctgtggcacgagatgtggcacgagggcctggaggaggcctcccgcctgtacttcggcgagcgcaacgtcaagggcatgttcgaggtcctggagccgctgcacgccatgatggagcgcggcccgcagaccctgaaggaaacctccttcaaccaggcctacggccgcgacctgatggaggcccaggagtggtgccgcaagtacatgaagtccggcaacgtcaaggacctgctgcaggcctgggacctgtactaccacgtcttccgccgcatctccaaggcggccgcatcgaattcccggggatcctcgagttaattaattaattaagatcttaggcgcgccggatctgtctagaccagatctcatcaccatcaccatcactaagcttaattagctgagcttggactcctgttgatagatccagtaatgacctcagaactccatctggatttgttcagaacgctcggttgccgccgggcgttttttattggtgagaatccaagctagaaatctgcattaatg

SEQ ID NO: 64 - DNA, 770 bp, Artificial Sequence
  Synthetic
actagtcaacacgcacggtgttaaggttctgttaagtaactttacactttatgcttccggctcgtatgttgtgtggcatatgtcccactccaagcaggccctggccgacaccatgaagatgacctggctgatggagggctccgtcaacggccacgccttcaccatcgagggcgagggcaccggcaagccgtacgagggcaagcagtccggcaccttccgcgtcaccaagggcggcccgctgccgttcgccttcgacatcgtcgccccgaccctgaagtacggcttcaagtgcttcatgaagtacccggccgacatcccggactacttcaagctggccttcccggagggcctgacctacgaccgcaagatcgccttcgaggacggcggctgcgccaccgccaccgtcgagatgtccctgaagggcaacaccctggtccacaagaccaacttccagggcggcaacttcccgatcgacggcccggtcatgcagaagcgcaccctgggctgggagccgacctccgagaagatgaccccgtgcgacggcatcatcaagggcgacaccatcatgtacctgatggtcgagggcggcaagaccctgaagtgccgctacgagaacaactaccgcgccaacaagccggtcctgatgccgccgtcccacttcgtcgacctgcgcctgacccgcaccaacctggacaaggagggcctggccttcaagctggaggagtacgccgtcgcccgcgtcctggaggtctaataaactactatctaga

SEQ ID NO: 65 - DNA, 31 bp, Artificial Sequence
  Primer
agttaggctaactagctagtcaacacgcacg

SEQ ID NO: 66 - DNA, 33 bp, Artificial Sequence
  Primer
ttgactagctagatagtagtttattagacctcc

SEQ ID NO: 67 - DNA, 23 bp, Artificial Sequence
  Primer
tatctagctagtcaacacgcacg

SEQ ID NO: 68 - DNA, 33 bp, Artificial Sequence
  Primer
tgagatctggtctagtcagccaatcgactggcg

SEQ ID NO: 69 - DNA, 2790 bp, Artificial Sequence
  Synthetic
ttagttaggctaactagtcatgcgagtgtccgttcgagtggcggcttgcgcccgatgctagtcgcggttgatcggcgatcgcaggagcacgcggtcgatcttgacggctggcgagaggtgcggggaggatctgaccgacgcggtccacacgtggcaccgcgatgctgttgtgggcacaatcgtgccggttggtaggatccacatatgagcacaaaaaagaaaccattaacacaagagcagcttgaggacgcacgtcgccttaaagcaatttatgaaaaaaagaaaaatgaacttggcttatcccaggaatctgtcgcagacaagatggggatggggcagtcaggcgttggtgctttatttaatggcatcaatgcattaaatgcttataacgccgcattgcttgcaaaaattctcaaagttagcgttgaagaatttagcccttcaatcgccagagaaatctacgagatgtatgaagcggttagtatgcagccgtcacttagaagtgagtatgagtaccctgttttttctcatgttcaggcagggatgttctcacctgagcttagaacctttaccaaaggtgatgcggagagatgggtaagcacaaccaaaaaagccagtgattctgcattctggcttgaggttgaaggtaattccatgaccgcaccaacaggctccaagccaagctttcctgacggaatgttaattctcgttgaccctgagcaggctgttgagccaggtgatttctgcatagccagacttgggggtgatgagtttaccttcaagaaactgatcagggatagcggtcaggtgtttttacaaccactaaacccacagtacccaatgatcccatgcaatgagagttgttccgttgtggggaaagttatcgctagtcagtggcctgaagagacgtttggcatgctcgagtccaccaccgaccgcgtcgtcaaggccgtcccgttcccgccgtcccaccgcctgaccgccaaggaggtcttcgacaacgacggcaagccgcgcgtcgacatcctgaaggcccacctgatgaaggagggccgcctggaggagtccgtcgccctgcgcatcatcaccgagggcgcctccatcctgcgccaggagaagaacctgctggacatcgacgccccggtcaccgtctgcggcgacatccacggccagttcttcgacctgatgaagctgttcgaggtcggcggctccccggccaacacccgctacctgttcctgggcgactacgtcgaccgcggctacttctccatcgagtgcgtcctgtacctgtgggccctgaagatcctgtacccgaagaccctgttcctgctgcgcggcaaccacgagtgccgccacctgaccgagtacttcaccttcaagcaggagtgcaagatcaagtactccgagcgcgtctacgacgcctgcatggacgccttcgactgcctgccgctggccgccctgatgaaccagcagttcctgtgcgtccacggcggcctgtccccggagatcaacaccctggacgacatccgcaagctggaccgcttcaaggagccgccggcctacggcccgatgtgcgacatcctgtggtccgacccgctggaggacttcggcaacgagaagacccaggagcacttcacccacaacaccgtccgcggctgctcctacttctactcctacccggccgtctgcgagttcctgcagcacaacaacctgctgtccatcctgcgcgcccacgaggcccaggacgccggctaccgcatgtaccgcaagtcccagaccaccggcttcccgtccctgatcaccatcttctccgccccgaactacctggacgtctacaacaacaaggccgccgtcctgaagtacgagaacaacgtcatgaacatccgccagttcaactgctccccgcacccgtactggctgccgaacttcatggacgtcttcacctggtccctgccgttcgtcggcgagaaggtcaccgagatgctggtcaacgtcctgaacatctgctccgacgacgagctgggctccgaggaggacggcttcgacggcgccaccgccgccgcccgcaaggaggtcgtcgagaacgaggcctcctacccgctggagatgtgctcccacttcgacgccgacgagatcaagcgcctgggcaagcgcttcaagaagctggacctggacaactccggctccctgtccgtcgaggagttcatgtccctgccggagctgcagcagaacccgctggtccagcgcgtcatcgacatcttcgacaccgacggcaacggcgaggtcgacttcaaggagttcatcgagggcgtctcccagttctccgtcaagggcgacaaggagcagaagctgcgcttcgccttccgcatctacgacatggacaaggacggctacatctccaacggcgagctgttccaggtcctgaagatgatggtcggcaacaacctgaaggacacccagctgcagcagatcgtcgacaagaccatcatcaacgccgacaaggacggcgacggccgcatctccttcgaggagttctgcgccgtcgtcggcggcctggacatccacaagaagatggtcgtcgacgtcgactacactagttaatataataccggatctgtctagaccagatctcatcaccatcaccatcactaagcttaattagctgagcttggactcctgttgatagatccagtaatgacctcagaactccatctggatttgttcagaacgctcggttgccgccgggcgttttttattggtgagaatccaagctagaaatctgcattaatg

SEQ ID NO: 70 - DNA, 8953 bp, Artificial Sequence
  Synthetic
aattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggttcatgtgcagctccatcagcaaaaggggatgataagtttatcaccaccgactatttgcaacagtgccgttgatcgtgctatgatcgactgatgtcatcagcggtggagtgcaatgtcgtgcaatacgaatggcgaaaagccgagctcatcggtcagcttctcaaccttggggttacccccggcggtgtgctgctggtccacagctccttccgtagcgtccggcccctcgaagatgggccacttggactgatcgaggccctgcgtgctgcgctgggtccgggagggacgctcgtcatgccctcgtggtcaggtctggacgacgagccgttcgatcctgccacgtcgcccgttacaccggaccttggagttgtctctgacacattctggcgcctgccaaatgtaaagcgcagcgcccatccatttgcctttgcggcagcggggccacaggcagagcagatcatctctgatccattgcccctgccacctcactcgcctgcaagcccggtcgcccgtgtccatgaactcgatgggcaggtacttctcctcggcgtgggacacgatgccaacacgacgctgcatcttgccgagttgatggcaaaggttccctatggggtgccgagacactgcaccattcttcaggatggcaagttggtacgcgtcgattatctcgagaatgaccactgctgtgagcgctttgccttggcggacaggtggctcaaggagaagagccttcagaaggaaggtccagtcggtcatgcctttgctcggttgatccgctcccgcgacattgtggcgacagccctgggtcaactgggccgagatccgttgatcttcctgcatccgccagaggcgggatgcgaagaatgcgatgccgctcgccagtcgattggctgagctcatgagcggagaacgagatgacgttggaggggcaaggtcgcgctgattgctggggcaacacgtggagcggatcggggattgtctttcttcagctcgctgatgatatgctgacgctcaatgccgtttggcctccgactaacgaaaatcccgcatttggacggctgatccgattggcacggcggacggcgaatggcggagcagacgctcgtccgggggcaatgagatatgaaaaagcctgaactcaccgcgacgtatcgatgtcgaggttcctcaggggagccaccccagagaagccctcggagctgagcggagctatttccaaagccatgccagctagagacagtgcacaccgccaagcatctgcaaaaccctcgcctggagggaaagtgcaatgtacgtacgctggtttccctccagaaagggattctgcggcttctcaactttggaagaagaggcggaacgaactgctgtttcagcctactcatgtgaggaggctggtcctttaccctgatgcccgagggcatcagggtaaaggaccagcctcgccaactaggagcgctaccaaggcgaacacaacccaggacttggtagaacccttcgccggagaagttcagactcatcggcatgagcacccctcgccgcgcactcggcaccggtccgtcgaccaccaccaggacgtcgttgtcgacgtcggccccgcggctcctgcccgccgaacgcgtcgtcgtcgacggcctggtgctcatcgacgagcacccggagccaggtgaaaagcgccggcggacgctcggactgggcgcgggattccagcagtaacccaggtccgccggccacctcacggcaggcagaccctcggctttcgcgccgggaccgccatgagaccgccacccggatgtccggggtggcggtctcatggcggtccctcagcggccctacgcgaccgctgtgtcgacgcggaggcagtctccggggtgctggccccagggctggagtaccggggcgagcttgcccttgcagcggcggcacacgggcgacgcggcgccgggcgggggagtcttgacgtcgacggtgaccggcttcggcttcaggcgcttccgaaggctgatcgtcgggcggatcgcctccttcttcggctgacgcactcggtcgagcgaagcggccagctcctccgtgcgggcctcgttggccttccggcgcgcctcgcggaaagcagcttcctcctcggacatgacctcgaacctcatctggtcagcgtcaaggtcgcccggcgcggccggcgcttccggggcgggcgggtccaggacgtccttgccccacaccaggccccaggactcgacgagccgccggacgcccggtaggccgtacgtctcggcgaccttgatgaggtcgaggcgacgtccggcgacgcgggcgatgtatcggtaccagatgtaggccgggatgaccgcgatggcgaccaggccctcggtgtcgtcggtgatctcctcctcggtgcggacgtcctgctggatgccgagttccttgatcagccggttcaggttctgcgaccggtagtgcttgcggacctggaagacgccgaactcgcgctcgcggtacttctcgacgaacgggccgggccgacgaagccgctgcagctcggcggccgccgcgtcgcccaggtcgagcggtcccatgcggtcgtcgccgcgaccggccttgaagttctgtccggccagctccaggccgatcttggcgacgccgtccttgtagaggtagcgggcctgcttgcccgcatcgccgtcagcggcgtccgcgccgttgagtgggcgcacgtcggtgccgtggcccttgccctcacaggagcaaccgggccggtcgcacgtctcgctgacggtgtagccgcccgcggattcgaccccggcggcccaggctccggcgagtgcgtcgcggaacgcggcctgggcgtccgggccgagcacctcgcgggtgacccagagcgtgtgccagtgcaggtgccagccggagccccagccgaaggtgtcctcgaaggcccgctcgtagccgatgatcccgaagtcgtcgcgcatcgtgcgccagcggcggccggacgagccgtacgcgcccttccagccgtcgtgcaagaccgcgaccaggccgtgccgcattcccttgcggacggtgccgaacgccatgcgctcgaagtggcgcaacgtgttcgtgccaaggtgcagcccgtacccggcgtccgcgagaccgtcggcggcgagctgcacgttcgagccccgtacggccaggatgcggctcatgcaccacgggcaggtgtggacgttgttgcagcggcacgtgttgccccacgtcgcctcgcccggcttccacatcagctcggccgtcccggcagtgagccgggtcccgcagcccttgaacgcctcgttcagcgacaccgtctggtgccggtcccgccgggcgaaccgctcgtcgcgcgggtcctcccgcccggctgtcgcggcaccctcgtttggggtagaacccgttccagttacagcgctctgacctgcagtggacggagattttcccttactactaagaggtcatctcatttggctgagtaggctgttgaccgtggcggggattgttgagcggctggtaccggacgagctgtgggagctgttccagcgggtggtgccggaggcgccatcgcggcctcagggcggcggccggcgtcgccacggtgaccgggaggtgctggctgcgatcgtgttcgtggcgacctcggggtgcacgtggcagcagctgcccgcggcgtcgttcgggccgtccggcgcgacggctcaccgccggttcaccgagtggacgaaggccagggtgtgggccaagctgcaccgcctggtcctcgatgaactcggctcccgcggcgacctggactggtcgaggtgcgcgatcgactcggtgaacatgcgggccctgaaaagggggacctgacaggtccgaatcctgtcgaccggggcaagtacggctcgaagatccacctgatcaccgagcggacgggtctgcccctgtccgtcggcatctccggcgccaacgtccacgacagccaggccttgatccccctggtgaagggcataccgcccatccggtcccgacgaggcccccgccggcgcaggcccggaagactccacgccgacaagggctacgactatcgccacctgcggcaatggctgtcccgccggggaatccggcaccgcatcgcccgcaagggcgtcgagacctcacagcgactcggccgacaccgctggaccatcgaacgcaccatggcctggctcaccggctgccgccgactccatcgccgctacgaacgcaaggccgaccacttcctcgccttcaccagcatcgcctgcaccctcatctgctaccgcagactcgccaaatgagatgacttctaaagcccgcgtccggattacccgctgtagtcgtgcttgctacgctgcgtgactggtccgcaatgagacgctttgcgcgctttcggcaggcgtccgagcagtagattttggggcgcttcccggggatgtggacgatcggggtgccgcagtggcacttcggtccggcggggcgcggtggtgtcgacgcgctgttctctcgtacgctcgtcacagagcaaacgtcctcactcggcatgctgcgccggttcgggggcggcgagcccgggaggccaatcccgggctcgtgccatttctgggtcctgttgatcctggcattggtgtggccgttcattgcccctgctcgctcctgacgcgccgatagacgtccgatacgcccggtgctggtgggatttgataggtcggaagaagccccgcccgggcctgggcggggcttcctgtgcgtcaggacctcctcgtcgtgagcctcttcggcctatggacggagtgacctcgtgatccgttacagccgcgcgcgctcgcgtagagcggtctcatcagttccacgaacggtcctcttcgcagatcagggcgttggggcggagtctcaccaaggactacgtctgctggcgatttccgttacaccccgggcggtggccggcgcacacgcgcgcccgcgttgggcagtgcagaaagtgcagaaacctaggcgctgatggtccaggtccacggttcgtcgtcggcggcggcgcgggcggcggcgtcggccagggcgcgggcgagaccggctacggcgggcttgatgcgccggttgcgggcgaccttgagcagctagtatgcaggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtgaagtacatcaccgacgagcaaggcaagaccgatccccggggacctgcatagatccacactagtctcgaggttgacatcttttgccgattctggtagaatgacaccaacatagatctgatcgatcaagagacaggatgaggatcgtttcatatgccgaacaacgccctgcagaccatcatcaacgcccgcctgccgggcgaggagggcctgtggcagatccacctccaggacggcaagatctccgccatcgacgcccagtccggcgtcatgccgatcaccgagaactccctggacgccgagcagggcctggtcatcccgccgttcgtcgagccgcacatccacctggacaccacccagaccgccggccagccgaactggaaccagtccggcaccctgttcgagggcatcgagcgctgggccgagcgcaaggccctgctgacccacgacgacgtgaagcagcgcgcctggcagaccctgaagtggcagatcgccaacggcatccagcacgtccgcacccacgtcgacgtgtccgacgccaccctgaccgccctgaaggccatgctggaggtcaagcaggaggtcgccccctggatcgacctgcagatcgtcgccttcccgcaggagggcatcctgtcctacccgaacggcgaggccctgctggaggaggccctgcgcctgggcgccgacgtggtgggcgccatcccgcacttcgagttcacccgcgagtacggcgtcgagtccctgcacaagaccttcgccctcgcccagaagtacgaccgcctgatcgacgtccactgcgacgagatcgacgacgagcagtcccgcttcgtcgagaccgtcgccgccctggcccaccacgagggcatgggcgcccgcgtcaccgcctcccacaccaccgccatgcactcctacaacggcgcctacacctcccgcctgttccgcctgctgaagatgtcgggcatcaacttcgtcgccaacccgctggtcaacatccacctgcagggccgcttcgacacctacccgaagcgccgcggcatcacccgcgtcaaggagatgctggagtccggcatcaacgtctgcttcggccacgccgacgtgttcgacccgtggtacccgctgggcaccgccaacatgctgcaggtcctgcacatgggcctgcacgtctgccagctgatgggctacggccagatcaacgacggcctgaacctgatcacccaccactccgcccgcaccctgaacctgcaggactacggcatcgccgccggcaactccgccaacctgatcatcctgccggccgagaacggcttcgacgccctgcgccgccaggtcccggtccgctactccgtccgcggcggcaaggtcatcgcctccacccagccggcccagaccaccgtctacctggagcagccggaggccatcgactacaagcgctgacctctagagcatgcgatctacaggatctacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaatttatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgggctgcaggtcgactctagaggatccgcggccgcgcgcgatatcg

SEQ ID NO: 71 - DNA, 2616 bp, Artificial Sequence
  Synthetic
ttagttaggctaactagtcatgcgagtgtccgttcgagtggcggcttgcgcccgatgctagtcgcggttgatcggcgatcgcaggagcacgcggtcgatcttgacggctggcgagaggtgcggggaggatctgaccgacgcggtccacacgtggcaccgcgatgctgttgtgggcacaatcgtgccggttggtaggatccacatatggagatcggctccgacccgctggccgaggtcgtcgcctgggccctggagcacctgcacgagcagttcgacgtcgagaccctggccgcccgcgcctacatgtcccgccgcaccttcgaccgccgcttccgctccctgaccggctccgccccgctgcagtggctgatcacccagcgcgtcctgcaggcccagcgcctgctggagacctccgactactccgtcgacgaggtcgccggccgctgcggcttccgctccccggtcgccctgcgcggccacttccgccgccagctgggctcctccccggccgcctaccgcgccgcctaccgcgcccgccgcccgcagggcgtcgccgagtccgccgccaccgtcgtcgagaccatggtcccgtcccagggcccgccgtccggccgccgcggctccaccctgtcctccgccgccgtcgccgtcgccgcctccgtcggctccggcgagctgtccctgccgggcccggacgcctacgtcccgggccgcccggccctgccgggccagcgctccgccccgctcgagtccaccaccgaccgcgtcgtcaaggccgtcccgttcccgccgtcccaccgcctgaccgccaaggaggtcttcgacaacgacggcaagccgcgcgtcgacatcctgaaggcccacctgatgaaggagggccgcctggaggagtccgtcgccctgcgcatcatcaccgagggcgcctccatcctgcgccaggagaagaacctgctggacatcgacgccccggtcaccgtctgcggcgacatccacggccagttcttcgacctgatgaagctgttcgaggtcggcggctccccggccaacacccgctacctgttcctgggcgactacgtcgaccgcggctacttctccatcgagtgcgtcctgtacctgtgggccctgaagatcctgtacccgaagaccctgttcctgctgcgcggcaaccacgagtgccgccacctgaccgagtacttcaccttcaagcaggagtgcaagatcaagtactccgagcgcgtctacgacgcctgcatggacgccttcgactgcctgccgctggccgccctgatgaaccagcagttcctgtgcgtccacggcggcctgtccccggagatcaacaccctggacgacatccgcaagctggaccgcttcaaggagccgccggcctacggcccgatgtgcgacatcctgtggtccgacccgctggaggacttcggcaacgagaagacccaggagcacttcacccacaacaccgtccgcggctgctcctacttctactcctacccggccgtctgcgagttcctgcagcacaacaacctgctgtccatcctgcgcgcccacgaggcccaggacgccggctaccgcatgtaccgcaagtcccagaccaccggcttcccgtccctgatcaccatcttctccgccccgaactacctggacgtctacaacaacaaggccgccgtcctgaagtacgagaacaacgtcatgaacatccgccagttcaactgctccccgcacccgtactggctgccgaacttcatggacgtcttcacctggtccctgccgttcgtcggcgagaaggtcaccgagatgctggtcaacgtcctgaacatctgctccgacgacgagctgggctccgaggaggacggcttcgacggcgccaccgccgccgcccgcaaggaggtcgtcgagaacgaggcctcctacccgctggagatgtgctcccacttcgacgccgacgagatcaagcgcctgggcaagcgcttcaagaagctggacctggacaactccggctccctgtccgtcgaggagttcatgtccctgccggagctgcagcagaacccgctggtccagcgcgtcatcgacatcttcgacaccgacggcaacggcgaggtcgacttcaaggagttcatcgagggcgtctcccagttctccgtcaagggcgacaaggagcagaagctgcgcttcgccttccgcatctacgacatggacaaggacggctacatctccaacggcgagctgttccaggtcctgaagatgatggtcggcaacaacctgaaggacacccagctgcagcagatcgtcgacaagaccatcatcaacgccgacaaggacggcgacggccgcatctccttcgaggagttctgcgccgtcgtcggcggcctggacatccacaagaagatggtcgtcgacgtcgactacactagttaatataataccggatctgtctagaccagatctcatcaccatcaccatcactaagcttaattagctgagcttggactcctgttgatagatccagtaatgacctcagaactccatctggatttgttcagaacgctcggttgccgccgggcgttttttattggtgagaatccaagctagaaatctgcattaatg

SEQ ID NO: 72 - DNA, 42 bp, Artificial Sequence
  Synthetic
attatggccagtacgatttgctatagcctggccagtacctta

SEQ ID NO: 73 - DNA, 26 bp, Artificial Sequence
  Synthetic
tctaaactacaaattagaaaatagcg

SEQ ID NO: 74 - DNA, 26 bp, Artificial Sequence
  Synthetic
tgttgaacacttcacggatgatagga

SEQ ID NO: 75 - DNA, 1377 bp, Artificial Sequence
  Synthetic
ctcgaggttgacatcttttgccgattctggtagaatgacaccaacatagatctgatcgatcaagagacaggatgaggatcgtttcatatgccgaacaacgccctgcagaccatcatcaacgcccgcctgccgggcgaggagggcctgtggcagatccacctccaggacggcaagatctccgccatcgacgcccagtccggcgtcatgccgatcaccgagaactccctggacgccgagcagggcctggtcatcccgccgttcgtcgagccgcacatccacctggacaccacccagaccgccggccagccgaactggaaccagtccggcaccctgttcgagggcatcgagcgctgggccgagcgcaaggccctgctgacccacgacgacgtgaagcagcgcgcctggcagaccctgaagtggcagatcgccaacggcatccagcacgtccgcacccacgtcgacgtgtccgacgccaccctgaccgccctgaaggccatgctggaggtcaagcaggaggtcgccccctggatcgacctgcagatcgtcgccttcccgcaggagggcatcctgtcctacccgaacggcgaggccctgctggaggaggccctgcgcctgggcgccgacgtggtgggcgccatcccgcacttcgagttcacccgcgagtacggcgtcgagtccctgcacaagaccttcgccctcgcccagaagtacgaccgcctgatcgacgtccactgcgacgagatcgacgacgagcagtcccgcttcgtcgagaccgtcgccgccctggcccaccacgagggcatgggcgcccgcgtcaccgcctcccacaccaccgccatgcactcctacaacggcgcctacacctcccgcctgttccgcctgctgaagatgtcgggcatcaacttcgtcgccaacccgctggtcaacatccacctgcagggccgcttcgacacctacccgaagcgccgcggcatcacccgcgtcaaggagatgctggagtccggcatcaacgtctgcttcggccacgacgacgtgttcgacccgtggtacccgctgggcaccgccaacatgctgcaggtcctgcacatgggcctgcacgtctgccagctgatgggctacggccagatcaacgacggcctgaacctgatcacccaccactccgcccgcaccctgaacctgcaggactacggcatcgccgccggcaactccgccaacctgatcatcctgccggccgagaacggcttcgacgccctgcgccgccaggtcccggtccgctactccgtccgcggcggcaaggtcatcgcctccacccagccggcccagaccaccgtctacctggagcagccggaggccatcgactacaagcgctgagcatgc

SEQ ID NO: 76 - DNA, 35 bp, Artificial Sequence
  Primer
ggccagtgccaagcttcgaacgccttgcaccggcc

SEQ ID NO: 77 - DNA, 31 bp, Artificial Sequence
  Primer
tgcccgacgggaagatcagcttctcgacgca

SEQ ID NO: 78 - DNA, 23 bp, Artificial Sequence
  Primer
tcttcccgtcgggcagtttgccc

SEQ ID NO: 79 - DNA, 34 bp, Artificial Sequence
  Primer
acatgattacgaattcctgtgggaggacgccagc

SEQ ID NO: 80 - DNA, 5302 bp, Artificial Sequence
  Synthetic
ctagtcatgcgagtgtccgttcgagtggcggcttgcgcccgatgctagtcgcggttgatcggcgatcgcaggtgcacgcggtcgatcttgacggctggcgagaggtgcggggaggatctgaccgacgcggtccacacgtggcaccgcgatgctgttgtgggcacaatcgtgccggttggtaggatccacatatggccctattctgcccagccgctctagaccagatctcatcaccatcaccatcactaagcttaattagctgagcttggactcctgttgatagatccagtaatgacctcagaactccatctggatttgttcagaacgctcggttgccgccgggcgttttttattggtgagaatccaagctagaaatctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggttcatgtgcagctccatcagcaaaaggggatgataagtttatcaccaccgactatttgcaacagcgccggtgatcgtgctatgatcgactgatgtcatcagcggtggagtgcaatgtcgtgcaatacgaatggcgaaaagccgagctcatcggtcagcttctcaaccttggggttacccccggcggtgtgctgctggtccacagctccttccgtagcgtccggcccctcgaagatgggccacttggactgatcgaggccctgcgtgctgcgctgggtccgggagggacgctcgtcatgccctcgtggtcaggtctggacgacgagccgttcgatcctgccacgtcgcccgttacaccggaccttggagttgtctctgacacattctggcgcctgccaaatgtaaagcgcagcgcccatccatttgcctttgcggcagcggggccacaggcagagcagatcatctctgatccattgcccctgccacctcactcgcctgcaagcccggtcgcccgtgtccatgaactcgatgggcaggtacttctcctcggcgtgggacacgatgccaacacgacgctgcatcttgccgagttgatggcaaaggttccctatggggtgccgagacactgcaccattcttcaggatggcaagttggtacgcgtcgattatctcgagaatgaccactgctgtgagcgctttgccttggcggacaggtggctcaaggagaagagccttcagaaggaaggtccagtcggtcatgcctttgctcggttgatccgctcccgcgacattgtggcgacagccctgggtcaactgggccgagatccgttgatcttcctgcatccgccagaggcgggatgcgaagaatgcgatgccgctcgccagtcgattggctgagctcatgagcggagaacgagatgacgttggaggggcaaggtcgcgctgattgctggggcaacacgtggagcggatcggggattgtctttcttcagctcgctgatgatatgctgacgctcaatgccgtttggcctccgactaacgaaaatcccgcatttggacggctgatccgattggcacggcggacggcgaatggcggagcagacgctcgtccgggggcaatgagatatgaaaaagcctgaactcaccgcgacgtatcgggccctggccagctagctagagtcgacctgcaggtccccggggatcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatccgtcgacctgcaggcatgctggcgccggacggggcttcagacgtttcgggtgctgggttgttgtctctggacagtgatccatgggaaactactcagcaccaccaatgttcccaaaagaaagcgcaggtcagcgcccatgagccaagatctaggcatgtcgcccttcatcgctcccgacgtccctgaacaccttctggacactgttcgcgtcttcctgtacgcgcgtcagtctaagggccggtccgacggctcagacgtgtcgaccgaagcacagctagcggccggtcgtgcgttggtcgcgtctcgcaacgcccaggggggtgcgcgctgggtcgtggcaggtgagttcgtggacgtcgggcgctccggctgggacccgaacgtgacccgtgccgacttcgagcgcatgatgggcgaagtccgcgccggcgaaggtgacgttgtcgttgtgaatgagctttcccggctcactcgcaagggcgcccatgacgcgctcgaaatcgacaacgaattgaagaagcacggcgtgcgcttcatgtcggttcttgagccgttccttgacacgtctacccctatcggcgtcgccattttcgcgctgatcgctgcccttgcgaaacaggacagtgacctgaaggcggagcgcctgaagggtgcgaaagacgagattgccgcgctgggtggcgttcactcgtcttccgccccgttcggaatgcgcgccgtgcgcaagaaggtcgataatctcgtgatctccgttcttgagccggacgaagacaacccggatcacgtcgagctagttgagcgcatggcgaaaatgtcgttcgaaggcgtgtccgacaacgccattgcaacgaccttcgagaaggaaaagatcccgtcgcccggaatggctgagagacgcgccacggaaaagcgtcttgcgtccatcaaggcacgtcgcctgaacggcgctgaaaagccgatcatgtggcgcgctcaaacggtccgatggattctcaaccatcccgcaatcggcggtttcgcattcgagcgtgtgaagcacggtaaggcgcacatcaacgtcatacggcgcgaccccggcggcaagccgctaacgccccacacgggcattctcagcggctcgaagtggcttgagcttcaagagaagcgttccgggaagaatctcagcgaccggaagcctggggccgaagtcgaaccgacgcttctgagcgggtggcgtttcctggggtgccgaatctgcggcggctcaatgggtcagtcccagggtggccgtaagcgcaacggcgaccttgccgaaggcaattacatgtgcgccaacccgaaggggcacggcggcttgtcggtcaagcgcagcgaactggacgaattcgttgcttcgaaggtgtgggcacggctccgcacagccgacatggaagatgaacacgatcaggcatggattgccgccgctgcggagcgcttcgcccttcagcacgacctagcgggggtggccgatgagcggcgcgaacaacaggcgcacctagacaacgtgcggcgctccatcaaggaccttcaggcggaccgtaaggccggtctgtacgtcgggcgtgaagagctggaaacgtggcgctcaacggtgctgcaataccggtcctacgaagcggagtgcacgacccgactcgctgagcttgacgagaagatgaacggcagcacccgcgttccgtctgagtggttcagcggcgaagacccgacggccgaagggggcatctgggcaagctgggacgtgtacgagcgtcgggagttcctgagcttcttccttgactccgtcatggtcgaccgggggcgccaccctgagacgaagaaatacatccccctgaaggaccgtgtgacgctcaagtgggcggagctgctgaaggaggaagacgaagcgagcgaagccactgagcgggagcttgcggcgctgtagcgcacagcgggaggggtcgagccggcggacggttcggccccttttttggccttgaaatcgttagttaggctaa

SEQ ID NO: 81 - DNA, 35 bp, Artificial Sequence
  Primer
gaaccgtccgccggatgcattgcgagagctgcatc

SEQ ID NO: 82 - DNA, 32 bp, Artificial Sequence
  Primer
ccgtcgacctgcaggcatgcgaagccccggcg

SEQ ID NO: 83 - DNA, 35 bp, Artificial Sequence
  Primer
tgtgcagctccatcggtaccggaattgccagctgg

SEQ ID NO: 84 - DNA, 38 bp, Artificial Sequence
  Primer
gccccagcagcggccgctcagaagaactcgtcaagaag

SEQ ID NO: 85 - protein, 260 aa, Streptomyces rapamycinicus
VFPGQGSQRAGMGEELAAAFPVFARIHQQVWDLLDVPDLDVNETGYAQPALFALQVALFGLLESWGVRPDAVVGHSVGELAAGYVSGLWSLEDACTLVSARARLMQALPAGGVMAAVPVSEDEARAVLGEGVEIAAVNGPSSVVLSGDEAAVLQAAEGLGKWTRLPTSHAFHSARMEPMLEEFRAVAEGLTYRTPQVAMAAGDQVMTAEYWVRQVRDTVRFGEQVASFEDAVFVELGADRSLARLVDGIAMLHGDHEAQA

SEQ ID NO: 86 - protein, 273 aa, Streptomyces rapamycinicus
VFPGQGWQWLGMGSALRDSSIVFAERMAECAPALREFVDWDLFTVLDDPAVVDRVDVVQPASWRMMVSLAAVWQAAGVRPDAVIGHSQGEIAAACVAGAVSMRDAARIVTLRSEAIARGLAGRGAMASVALPAQDVELVDGAWIAAHNGPASTVIAGTPEAVDHVLTAHEARGVRVRRITVDYASHTPHVELIRDELLDITSDSSSQAPVVPWLSTVDGSWVDSPLDVEYWYRNLREPVGFHPAVGQLQAEGDTVFVEVSASPVLLQAMDDDV

SEQ ID NO: 87 - DNA, 39 bp, Artificial Sequence
  Synthetic
  misc_feature (1)..(5): n is a, c, g, or t
nnnnngcacgggggtacgcgtgtcgtggcggtgcccagg

SEQ ID NO: 88 - DNA, 34 bp, Artificial Sequence
  Synthetic
cctgggcaccgccacgacacgcgtaccacagtgc

SEQ ID NO: 89 - DNA, 21 bp, Artificial Sequence
  Primer
gcagtacagatgggcgtccag

SEQ ID NO: 90 - DNA, 37 bp, Artificial Sequence
  Primer
tgagatctggtctagatagtgatggtgatggtgatga

SEQ ID NO: 91 - DNA, 24 bp, Artificial Sequence
  Primer
gcccatctgtactgctcggtctcc

SEQ ID NO: 92 - DNA, 30 bp, Artificial Sequence
  Primer
ggtaggatccacataatgctgatcgctcag

SEQ ID NO: 93 - DNA, 224 bp, Artificial Sequence
  Synthetic
actagtcaacacgcacggtgttaaggttctgttaagtaactttacactttatgcttccggctcgcactgcatctccgtcagaccgtcgcatcggggggcagacggatgacgaccgagcccaccagttagtgtgcggctccgcgcgcccgtccggcagcctacgggggagctaccggacgggcgttgctacctcgtcacgacccatgaggagcgaagcatatgtc

SEQ ID NO: 94 - DNA, 31 bp, Artificial Sequence
  Primer
atgttgtgtggcatatgatgtcatcagcggt

SEQ ID NO: 95 - DNA, 31 bp, Artificial Sequence
  Primer
acctgcagcttctagatcagccaatcgactg

SEQ ID NO: 96 - DNA, 22 bp, Artificial Sequence
  Primer
cgcaattaatgtgagttagctc

SEQ ID NO: 97 - DNA, 37 bp, Artificial Sequence
  Primer
tgagatctggtctagatcagaattggttaattggttg

SEQ ID NO: 98 - DNA, 17 bp, Artificial Sequence
  Primer
cccagccgctctagacc

SEQ ID NO: 99 - DNA, 26 bp, Artificial Sequence
  Primer
atataggtacccgcgttggccgattc

SEQ ID NO: 100 - DNA, 34 bp, Artificial Sequence
  Primer
ctcacattaattgcgggtacgcgtgtcgtacgcc

SEQ ID NO: 101 - DNA, 34 bp, Artificial Sequence
  Primer
tagaaatctgcattaatacacgcgtacccccgtg

SEQ ID NO: 102 - DNA, 29 bp, Artificial Sequence
  Primer
ctgcaggtcgactttagaggatccccggg

SEQ ID NO: 103 - DNA, 29 bp, Artificial Sequence
  Primer
cccggggatcctctaaagtcgacctgcag

SEQ ID NO: 104 - DNA, 1156 bp, Artificial Sequence
  Primer
gctcttcggacgagccgttggcgattgtgggtatggcgtgccgtctgccgggtggggtgtcgtccccggaggatctgtggcgccttgtcgagtcgggtacggacgcgatttccggattccccgccgaccgtggctgggacgtcgagaacctgtacgaccctgatccggaggcggcaggcaagtcgtactgcgtgcagggcggcttcctggactccgcaggcggtttcgacgcctcgttcttcgggatcagtcctcgtgaggcgttggcgatggatccgcagcagcggctggtcctggaggcgtcctgggaagcgttcgaacgggccgggatcgaacccggttccctccgcggtagcgacaccggtgttttcatgggtgcgtaccccggtggctacggcgttggtgccgacctcggcggcttcggggcaactgccggtgcggtgagtgtcctgtcgggtcgggtgtcgtatttcttcggcctcgaggggccggctgtcacggtggacacggcgtgttcgtcgtcgttggtggcgttgcatcaggcggcgtatgccctgcggcagggtgagtgttcgctggccctggtcggtggtgtcactgtgatggccacgccgcaaagtttcgtggagttctcgcggcagcgtggcctggcctccgacggccggtgcaaggcgttcgcggatagtgcggacggcacgggctgggctgaaggcgccggtgtgctgctggtagagcggctgtccgatgcccagcgcaagggccaccaggtgcttgcggtggtgcggggatcggcggtcaatcaggacggtgcgtcgggtacgcgtgtcgtacgccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatggtgatggcgctgcagcgcggtttcgtgccgcgtacgttgcatggaagagc

SEQ ID NO: 105 - DNA, 31 bp, Artificial Sequence
  Primer
ctcacattaattgcgggtacgcgtgtcgtac

SEQ ID NO: 106 - DNA, 34 bp, Artificial Sequence
  Primer
tagaaatctgcattaatacacgcgtacccgacgc

SEQ ID NO: 107 - DNA, 21 bp, Artificial Sequence
  Primer
taatgcagatttctagcttgg

SEQ ID NO: 108 - DNA, 3514 bp, Artificial Sequence
  Plasmid
gctcttcccacctgtatgtcaacggagtgaccgtggactggacagcgctactgggagatgtccctgtgacgcgagtgctggacctgccgacgtatgcgttccaacaacaacggtactgggcagaagtgggtcggtcagcagatgtgagtggagccggtctggatgctgtggggcatccactcctgggagcagtggtggcactgccagggtctgatggagtacttctgaccggccgagtgagtctggcgacacatgcgtggctggcagatcatgcagtccgaggaagtgtgctactgcctggaaccgggttcgtggaactggtggtgcgagctgcagatgaagtggggtgtgatgtggtggatgaactgatcgtggaagcaccgctgcttcttccgcaaactggaggagtccaagtgagtgtgagtgtgggagaagccgatgagtcaggacaccgagtggtgacgatattcagtcgagccgacaatgcagacacgtgggtgagacatgtgagtgctgtgataagcacgtcagacagcaccgtgagcctgagtgagttcgcgtcgtggccgcccgcgcaagcgcaaccagtggatgtgactgggttctatgacccactgatggcagaagggtatgagtatggcccagcgtttcaaggcctacaagccgcgtggcggtatggagacactgtgttcgccgaagtggcgctggccgaagaacaagtgcgagaagccgcacggtatccgtctgtccatcccgcgctactggatgccgcactacatgcgtgcacgctggagtgtgctgatgctgaagtgggagtgggacttccgttctcgtgggatggagtgcgagtacatgctggagggtctgcgatgcttcgagtggcagtgacgcaagcagctgatgggtggtcagtccgagtggctgatgaaatcggtcggccagtggcgaatgtggggtcactggtgacacgccccgtgacagcagatgcactgggaagtgccgctgatgacctgctagcactgacgtgggctgaaatccctgcgcccgaaggaaccggactgaccgtggggcggttcgaagaactggtgagtgatggagatgtccccgttccagaagtggcagtgttcaccgcacttcctgacaatgatgatgacccactggaacaaacacgaaaactgaccggtcaagtgctgcaagcagtacaagagtggctgggaggagaacggttcagtgacagcacactggtggtgagaaccggaactgggctggccgcagcaggagtgagtggtctgatgagaagtgcacagtcagaacatcctggacggttcgtgctggtggagtctgatgatgatgcactggcactggatcaactggcagcagcagtggggctggatgaaccgcgcctccgaatatccgatgggcggttcgaagcaccgcgactgacacgaacacatgccgctgaacccgagtcagaaaaagtgtgggatcctgatggaacagtactgataaccggagggtccggagtactggccggaatcgcagttcggcacctggtgactgaacgaggagtgagacaccttctactgctgagccgaagtgcacctgatgaagcactgataaaccaactgggagaactgggagcgcgagtggaaaccgcagcgtgtgatgtgagtgatcgagccgcgctggcacaagttctggcaggagtgagtcccgaacacccgctgacagcagtgattcacacagcaggagtcctggatgatggagtggtggagtcactgaccgcgcaacggctggatgcagttctacggccgaaagcagatggagcgtggaaccttcatgaactgacacgagatgccgacctggcagcgttcgtgatgtacagcagtgctgctggagttctgggaagtggaggacaaggaaactatgctgccgcgaatgcgtttctggatgcgctggcagaacaacggcatgctgaaggcctacctgcactggctgtggcgtggggtctgtgggaagatgcatccggcctgacagcgcaactgaccgacaccgatcgagatcgaatacggcgaggaggacttcgagcgatatcagctgaacatggaatggggctgttcgacagtgcgtcacgacacagtgaacccgtactggtggcagcgccgatggaacccgtccgagatgctgaagtacccgcactactgagaagtctacaccgacctgtggcgcgtcgagcagctgctgctggaggagcacgatggctggcagcactggcacccgcagaacgagaaaaagcactactgaaactggtgagtgatggagcagcgactgtactgggccatgctgacacgtcgacgatacccgcgacgaccgcgttcaaagatctgggaatcgacagcctgaccgccgtggaactgcgaaacagcctggcgaaagcgactgaactgagactcccagcgacgctggtgttcgactatccgacaccgacagcgctggcagcgcgtctggatgaactgttcacaggagaaaatccagcacctgtacgaggacccgtgagtgccgtggcacaagatgaaccactggcgatcgtgggaatggcgtgtcggctacctggaggagtgagctcgcctgaagatctgtggcgcctggtggagtccggaaccgatgcgatatcagggttcccgactgatcgagggtgggatgtggaaaacctgtatgatcccgaccccgatgcaccaggaaagtcgtacagtgtacaaggagggtttctggatgcagcagcagggttcgatgcgtcgttcttcggaataagtccacgagaagcgctggcgatggatccgcaacaacgactgatgctggaagtgagctgggaagcgttcgaacgagccggaatcgaaccaggaagtgtacgagggtccgacactggagtgttcatcggagcgtatcccggagggtatggaatcggagccgatctgggagggttcggaacgacagcaggagcagcgtctgtactgagtggtcgagtgagctacttcttcggcctggaaggcccagcgttcactgtggacaccgcgtgcagcagcagtctggtggcgcttcaccaagcaggatatgcgctgaggcaaggagagtgcagtctggcgctggtgggaggagtgactgtgatgccgacgccgcaaacgttcgtggagttcagtcggcaacgaggactgtctgcagatgggcggtgcaaagcgttcgctgatgccgcagatggaactgggtgggcagaaggagtgggagtacttctggtggaacggctgagtgatgcacaagcgaatggtcatcaaatcctggccgtggttcggtcgtccgccgtgaaccaagatggagcgtcgaatggactgagtgcgccgaatggtccgtcacaacaacgagtgattcgagcagcgctgagcaatgccgggctggcaccgcatgaagtggatgtggtggaagcgcatggaaccggaacgacgctgggtgaccgaagagc

SEQ ID NO: 109 - DNA, 671 bp, Artificial Sequence
  Primer
agctgctcttcggacgagccgttggcgattgtgggtatggcgtgccgtctgccgggtggggtgtcgtccccggaggatctgtggcgccttgtcgagtcgggtacggacgcgatttccggattccccgccgaccgtggctgggacgtcgagaacctgtacgaccctgatccggaggcggcaggcaagtcgtactgcgtgcagggcggcttcctggactccgcaggcggtttcgacgcctcgttcttcgggatcagtcctcgtgaggcgttggcgatggatccgcagcagcggctggtcctggaggcgtcctgggaagcgttcgaacgggccgggatcgaacccggttccctccgcggtagcgacaccggtgttttcatgggtgcgtaccccggtggctacggcgttggtgccgacctcggcggcttcggggcaactgccggtgcggtgagtgtcctgtcgggtcgggtgtcgtatttcttcggcctcgaggggccggctgtcacggtggacacggcgtgttcgtcgtcgttggtggcgttgcatcaggcggcgtatgccctgcggcagggtgagtgttcgctggccctggtcggtggtgtcactgtgatggccacgccgcaaagtttcgtggagttctcgcggcagcgtagagaccacgcgtgtattaatgc

SEQ ID NO: 110 - DNA, 152 bp, Artificial Sequence
  Primer
aattgcgggtacgcgtggtctcattgctgctgggttcggtgaagtcgaatctgggtcatacgcaggctgctgcgggtgtgtcgggtgtcatcaagatggtgatggcgctgcagcgcggtttcgtgccgcgtacgttgcatggaagagcacat

SEQ ID NO: 111 - DNA, 35 bp, Artificial Sequence
  Primer
aattgcgggtacgcgtggtctcgggtgtcatcaag

SEQ ID NO: 112 - DNA, 16 bp, Artificial Sequence
  Primer
atgtgctcttccatgc

SEQ ID NO: 113 - DNA, 29 bp, Artificial Sequence
  Primer
atatatgggccctgatccttcaactcagc

SEQ ID NO: 114 - DNA, 35 bp, Artificial Sequence
  Primer
atatatgggcccttagaaaaactcatcgagcatca

SEQ ID NO: 115 - DNA, 28 bp, Artificial Sequence
  Primer
gcaggaaagaacatgtccacgggtgcgc

SEQ ID NO: 116 - DNA, 30 bp, Artificial Sequence
  Primer
ccttttgctcacatgggagctgcatgtgtc

SEQ ID NO: 117 - DNA, 444 bp, Artificial Sequence
  Primer
ttctcgcggcagcgtggcctggccggtgacggtcgcagtaaggcgttcgcggacagtgcggacggcgccggcttctccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 118 - DNA, 444 bp, Artificial Sequence
  Primer
ttctcgcggcagcgtggcctggcctccgacggccggagtaaggcgttcgcggacagtgcggacggcgccggcttctccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 119 - DNA, 444 bp, Artificial Sequence
  Primer
ttctcgcggcagcgtggcctggcctccgacggccggtgcaaggcgttcgcggatagtgcggacggcacgggcttctccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 120 - DNA, 444 bp, Artificial Sequence
  Primer
ttctcgcggcagcgtggcctggcctccgacggccggtgcaaggcgttcgcggatagtgcggacggcacgggctggtccgaaggtgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 121 - DNA, 444 bp, Artificial Sequence
  Primer
ttctcgcggcagcgtggcctggcctccgacggccggtgcaaggcgttcgcggatagtgcggacggcacgggctgggctgaaggcgtcggtgtgttgttggtggagcgtttgtcggacgctcaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 122 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagagcggctgtccgatgcccaggccaagggccaccaggtgctggcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 123 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagagcggctgtccgatgcccagcgcaagggccaccaggtgcttgcgatgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 124 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagagcggctgtccgatgcccagcgcaagggccaccaggtgcttgcggtgctgcgcagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 125 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagagcggctgtccgatgcccagcgcaagggccaccaggtgcttgcggtggtgcggagttcggcggtcaaccaggacggtgcgtcgaacggtctgaccgcgccgaatggcccttcccagcagcgggtgatccaggctgccctcagcaacgccggccttgcggcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 126 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagaacggctgtccgatgcccagcgcaagggccaccaggtgcttgcggtggtgcggggatcggcggtcaatcaggacggtgcgtcgaacggcctgtccgcgccgaacggtccttcgcagcagcgggtgatccaggctgccctcagcaacgccggccttgcggcacacgaagtggatgtggtcgaagcgcacggcacgggtacgacgctgggtgacccgatcgaagcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 127 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagaacggctgtccgatgcccagcgcaagggccaccaggtgcttgcggtggtgcggggatcggcggtcaatcaggacggtgcgtcgaacggcctgtccgcgccgaacggtccttcgcagcagcgggtgatccgggcggctctcagcaatgcgggtctggcggcacacgaagtggatgtggtcgaagcgcacggcacgggtacgacgctgggtgacccgatcgaagcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 128 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagagcggctgtccgatgcccagcgcaagggccaccaggtgcttgcggtggtgcggggatcggcggtcaatcaggacggtgcgtcgaacggcctgtccgcgccgaacggtccttcgcagcagcgggtgatccgggcggctctcagcaatgcgggtctgagtgcacacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 129 - DNA, 444 bp, Artificial Sequence
  Primer
ttctcgcggcagcgtggcctggcctccgacggccggtgcaaggcgttcgcggatagtgcggacggcacgggctgggctgaaggcgccggtgtgctgctggtagagcggctgtccgatgcccagcgcaagggccaccaggtgcttgcggtggtgcggggatcggcggtcaatcaggacggtgcgtcgaacggcctgtccgcgccgaacggtccttcgcagcagcgggtgatccgggcggctctcagcaatgcgggtctgagtacgcacgaggtggatgtggtcgaggcgcacggcacgggtacgacgctgggtgacccgatcgaggcccaggcgttgctggcgacctatggccaggatcgtgagcagccgttgctgctgggttcggtgaagtcgaatctgggtcatacgcaggctgctgcgggtgtgtcgggtgtcatcaagatg

SEQ ID NO: 130 - DNA, 3514 bp, Artificial Sequence
  Plasmid
gctcttcagtgccacgactgacccgtacgcatgccgctgaacccgagtcagaaaaggtgtgggatccggatggcacggtcctgatcaccggtggttcgggtgtgctggcggggatcgccgcccggcacttggtggccgagcgtggcgtgcgtcatctgctgctgctgtcccgcagcgcaccggacggggcactgatcagcgagcttggcgaactgggcgcccaggtggccacagcggtttgcgacgtatcggatcgccctgggttggtgcgggtgctggcggacgtgtcaccggagcatcccctgacggcggtgattcataccgcgggtgtggtggacgacggtgtggtggagtccctgaccgcgcagcgactggacacggtactgcggcccaaggccgacggtgcctggcacctccacgagctcacccgtgacgccgacctggccgcgttcgtcatgtactcctcggccgccggtgtattcggtagcgcggggcaaggcaactatgcggtggcgaacgcgttcctggacgctctcgcagagcaacgtcgtgccgagggcctgcccgcactcgcactcgcctggggcctctgggagggcaccagcggcctgaccgccaatctgaccgatacagaccatgaccggatccggcgcagcggcatgcgggccatctccgccgagcatggaatgcggctgttcgacggcgcgtcacgccgcagggacccggttctggtggccgcggcgatggagccggtacgtgaagccgaagtccctgcgatgctccgttcgttgcaccgtcctgtcgcccggcgggcggcctccggtggtgcggtgcggtgcctggccgctctggcgccggaggagcgggcgaaggcactggtgaaggtggtgtgtgacagtgccgcgacggttctgggacacgccgacgtcgacagtattccggtgaccgccgcgttcagggatctgggcgtggattcgctgacggcggtggaactacggaacagcctgacgaaggccacgggactgcggctgcccgccacgttggtgttcgactacccgaccccaggtgccctggccgcccggttggaggagctgttcaccggcgagaatcctgttcaggtacgcacgccggtgtcggcggtggggcaggacgagccgttggcgatcgtgggcatggcctgccgcctgcctggtggggtgtcgtcgcctgaggatctgtggcgccttgtggaatcgggtacggatgcgatttccggtttccccaccgaccgtggctgggacgtggagaacctgttcgactcggatccggatgcggccgggaagtcgtactgcgtagagggtggcttcctggcgaccgctgccaacttcgatgcctcgttcttcgggatcagtccgcgtgaggcgttggcgatggatccgcagcagcggctggtgctggaggtgtcctgggaggcgttcgagcgggctgggatcgagcccggttccgtacgcggcagcgacaccggcgtcttcatgggcgctttcccgggcggttacggcatcggcgcagacctcgaaggttatggtgcgaccgctggcctcaacgtgctgtccggccggctgtcgtacttcttcggtcttgaggggccggccgtcacggtggacacggcgtgttcctcgtcgctggtcgccctgcaccaagcggggtatgccctgcgacagggtgagtgctcgctggccctgatcggcggtgtgaccgtgatggccacaccacataccttcgtggagttctcccggcagcgtggcctggcatccgatggccggtgcaaggcgttcgccgacagcgcggacggcacgggatggtctgagggagtcggcgtcctgctggtcgagcgcctgtcagacgctcaggccaagggccaccaggtattggcagtggtccgcagctcggcggtcaaccaggacggcgcgtcgaacggcctgtccgcgccgaatggcccctcgcaacagcgggtgatccggcaggcgctggccaacgcgggcctgaccacggccgaggtggatgtggtcgaggcccacggcacgggtacgacgttgggtgacccgatcgaggcccaggcggtgatcgcgacctacggtcaggatcgtgaccagcctgtgctgctgggttcggtgaagtcgaacgtcggtcatacgcaggctgccgcgggtgtgtcgggtgtcatcaagatggtgatggcgctgcagcacggtctggtgccgcgtacgttgcatgtggatgagccgtcgcggcatgtggactggacggatggcgcggttgagctggtgacggagaaccagtcctggcccgaagccggtcggccgcgccgggcaggcgtgtcgtccttcggagtcagtggcactaatgcccacgtcatcctggagagcgcaccccccacgcaggccgtggacgatgtgcggcctgcggatgcgccggtggtggcgtcggtgatggcctcggagttggtgccgttggtgatttcggccaagacgcagtcggcactggctgagtacgagggccggttgcgtgcgtatctggcggcgtcgcccggggtggatatgcgggctgtggcatcgacgctggcgatgacacggtcggtgttcgagcaccgtgcggtgatcgtgggtgatgacactgttagtgggaccgcggcgaccgatccgcgggtggtgttcgtcttcccggggcaggggtcgcagcgtgctggtatgggtgcggaactggccgccgcgttccccgtcttcgcgcggatccatcagcaggtctgggacctgctcgatgtgcccgatctggaggtgaatgagacgggttacgcccagccggctttgttcgctttgcaggtcgctctgttcgggttgctggaatcgtggggtgtacggccggacgcggtgatcggccattcggtgggtgagcttgcggctgcgtacgtgtccgggttgtggtcgttggaggatgcctgcactttggtgtcggcgcgggctcgtctgatgcaggctctgcctgcgggtggggtgatggtcgctgtcccggtgtcggaggatgaggctcgggccgtgctgggtgagggtgtggagatcgccgcggtcaacggcccgtcgtcggtggttctctccggtgatgaggccgctgtgctgcaggccgcggaggggctggggaagtggacgcggctggcgaccagtcacgcgttccattccgcccgtatggagccgatgctggaggagttccgggcggtcgctcaaggcctgacctatcacgcacctggtgtcgtgatggccgctggtgatcgggtgatgacggctgagtattgggtgcggcaggtccgggatacggtccggttcggcgagcaggtcgcctcatacgaggacgccgtgttcgtcgagctgggtgccgaccggtcactggcccgcctggtcgacggcgtcgcgatgctgcacggcgaccacgaaacccaggccgcgatcggcgccctggcccacctgtatgtcaacggaagagc

SEQ ID NO: 131 - DNA, 3514 bp, Artificial Sequence
  Plasmid
gctcttcggacgagccgttggcgatcgtgggaatggcgtgtcgccttcctggaggagtgagcagccctgaagatctgtggcgtctggtggagtctggaactgatgcgatatccgggtttccagccgatcgagggtgggatgtggaaaacctgtatgatccagatccagaagccgcaggaaagtcgtactgtgttcaaggagggtttctggacagtgccggagggttcgatgcgtcgttcttcggaataagcccacgagaagcactggcgatggacccgcaacaacgactggttctggaagcgtcgtgggaagcgttcgaacgagctggaatcgaacctgggtcgctgagaggaagtgacactggagtgttcatgggagcgtacccaggagggtatggagtgggagcagatctgggagggttcggagcgacagctggagcagtgagtgtactgagtggtcgagtgagctacttcttcggtctggaagggcctgctgtgaccgtggacactgcgtgctcgtcgtcactggtggcactgcatcaagctgcgtatgcgctacgccaaggagagtgcagtctggcactggtgggaggagtgacagtgatggcgacgccgcagtcgttcgtggagttcagtcgccaacgtggcctggcgtcagatggacggtgcaaagcgttcgccgacagtgctgatggaactgggtgggcagaaggagcaggagtcctgctggtggaacgactgtcagatgcgcaacgaaaaggccatcaagttctggctgtggtgagagggtccgccgtgaatcaagatggagcgtcgaatggtctgagtgcgccgaatggcccgtcgcaacaacgagtgatccgagctgcactgagcaatgctgggctgagcaccgctgaagtggatgtggtggaagcgcatggaaccggaacgacgctgggagatccgatcgaagcacaagcacttctggcgacgtatggtcaagatcgagaacaaccactccttctggggtctgtgaaaagcaacctgggccacacacaagctgcagccggagtgagtggagtgataaaaatggtgatggcgctgcaacatgtcctggtcccgcgaacgcttcatgtggatgaaccgtcgcgacatgtggactggacagatggagcagtggcactggtgaccgaaaaccaaccgtggcctgacatggggcgtccgcggcgagcaggagtgagctcattcggaatatcaggaacgaatgcgcatgtgatcctggagtccgcgccaccgacgcaagctgtggatgatgtgccgcccgctgaagcacctgtggtggcgtcagaactggttccgctggtgatatcagcacggacactccctgcactggtggagtatgaagatcgtctccgagcgtacctcgcagcgtcaccaggagtggatgtacgaggagtggcgtcgacgctggctgtgacacggtcagtgttcgaacaccgagctgtccttctgggagatgacactgtgacaggaacgacagtgagtgacccacgagtggtgttcgtgtttcccgggcaaggaagtcaacgagctggaatgggagaagaactggcagctgcgtttcctgtgttcgcacgaatacatcaacaagtgtggggactactggatgtgcccgacctggaagtgaatgaaaccgggtatgcacaaccagcactgttcgcacttcaagtggcgctgttcgggcttctggagtcgtggggagtgcggccagatgctgtggtgggccacagtgtgggagaactggcagctgggtatgtgagtggtctgtggtcgctggaagatgcgtgcacactggtgagtgcacgagcgcggctgatgcaagcactaccgccaggaggagtgatggtggctgttcctgtgagtgaagatgaagcacgagccgtactgggagaaggtgtggaaatcgccgcagtgaatggaccgtcgtctgtggttctgagcggagatgaaacagccgtccttcaagcagcagccgcgctgggaaagtcgacgcgtctggcgacgtcacatgcgtttcacagtgcgcgaatggaaccgatgctggaagagtttcggaccgtggccgaacggctgacgtatcaaacaccacgtctggcgatggccgctggagatcgagtgacgacagccgagtactgggtgaggcaagtccgagacactgtgaggttcggagaacaagtggcgtcgtatgaagatgcagtgttcatcgaactgggagctgaccggtcgctggcgcgcctggtggatggagtggcgatgcttcacaccgatcatgaagcacaagctgcgatatctgcgctggcgcacctgtatgtgaatggagtgaccgtggactggactgcactactgggagatgcacccgcgacacgagtactggacctgccgacgtatgcgttccaacaccaacggtactggctggaaggagctgatcgagcagcagctggaggtcacccactcctgggtcctgctgtgggtctggccgaagcgtcaggagttctgttcacgtcgcaagtaagtcggtcaggagatctgtggctgcaagaccaaaccgttctacccgcgactgcgttcgccgaaatggcactggctgccgcagatgaaacagggtgtggactggtggaagagttgacagtggaagcgctactccttctacccgatgatggagccgtgcaagttcaaacgtgggtgagtgaacccgatgatgccggtcgccgacaactgagcattcatgcacggtacagtgatgatgaactgtggacacgactggcaactgcgacactggcgacgacgactggccgagtatcagggtggcaagctggagaagcgtggccaccagctggagccgtaccagtggaagcacgagtaccatcgctgagaggagtatggcggcgagggtccgaagtgttcgctgaagtggcgctggatgacacacatgatgcgacgcggttcctcctgcaccctggactgatgactgcagcgttcgctgctgtgggagaagaaacgcctgcagcgtggcaaggtctgacactccatgcacgaaatgctgccgaactccgagtccgcctgacgtcgcaagatgatgaaacgctgagtgtggaagctgtggacagcactggactacccgtgctgacagcacggtcgctggcactggatgctgtgcctgtgaatgaacccgcgacgtctgcgacagacctgttgacgctgacgtgggcaggaatcgcgacacggcaacaacaaacaggactgaccgtgggagcgttcgaagatctggcagcagatggagatgcgccagtccctgatgtggtggtgttcaccgcactacctggaaatgatgatccactggcacaaacacgaattctgaccgcacaagttctgcgaaccgtccaagagtggatcggaggagaacggttcagtgacagcacgctggtggtacgaactggaactgggctggccgcggcagcggtgtcgggaagagc

SEQ ID NO: 132 - DNA, 40 bp, Artificial Sequence
  Primer
agcttgctcttcggtgccacgactgacccggtcttcacag

SEQ ID NO: 133 - DNA, 40 bp, Artificial Sequence
  Primer
tcgactgtgaagaccgggtcagtcgtggcaccgaagagca

SEQ ID NO: 134 - DNA, 40 bp, Artificial Sequence
  Primer
tcgactcggaagacggggcctgtgggaggacggaagagct

SEQ ID NO: 135 - DNA, 40 bp, Artificial Sequence
  Primer
ctagagctcttccgtcctcccacaggccccgtcttccgag

SEQ ID NO: 136 - DNA, 40 bp, Artificial Sequence
  Primer
agcttgctcttcggacgagccgttggcgatgtcttcacag

SEQ ID NO: 137 - DNA, 40 bp, Artificial Sequence
  Primer
tcgactgtgaagacatcgccaacggctcgtccgaagagca

SEQ ID NO: 138 - DNA, 40 bp, Artificial Sequence
  Primer
tcgactcggaagacaagtgccacgactgaccggaagagct

SEQ ID NO: 139 - DNA, 40 bp, Artificial Sequence
  Primer
ctagagctcttccggtcagtcgtggcacttgtcttccgag

SEQ ID NO: 140 - DNA, 37 bp, Artificial Sequence
  Primer
agcttgctcttcgcgaggtggatgtggtcgtccactg

SEQ ID NO: 141 - DNA, 37 bp, Artificial Sequence
  Primer
tctacagtggacgaccacatccacctcgcgaagagca

SEQ ID NO: 142 - DNA, 41 bp, Artificial Sequence
  Primer
tagacgactccagctacggcgatagtttaaactgccagctg

SEQ ID NO: 143 - DNA, 41 bp, Artificial Sequence
  Primer
agcgcagctggcagtttaaactatcgccgtagctggagtcg

SEQ ID NO: 144 - DNA, 48 bp, Artificial Sequence
  Primer
cgctggagcttgatcatgcgggtgccgccggtgtgtcggggaagagct

SEQ ID NO: 145 - DNA, 48 bp, Artificial Sequence
  Primer
ctagagctcttccccgacacaccggcggcacccgcatgatcaagctcc

SEQ ID NO: 146 - DNA, 3521 bp, Artificial Sequence
  Primer
gctcttcacgcgcctacctggcggcgtcgcccggagtggatacacgggctgttgcatcaacgctcgcggtgacacggtcggtgttcgagcaccgcgccgtactccttggagacgacaccgtcaccggcaccgctgtgtccgatccccgggtggtgtttgttttcccggggcaggggtggcagtggctggggatgggcagtgcgctgcgcgattcctcgatcgtgttcgccgagcggatggccgagtgcgcgcccgcgttgcgcgagttcgtggactgggacctgttcacggttctggatgatccggcggtggtggaccgggttgatgtggtccagcccgcttcctggcggatgatggtgtccctggccgcggtgtggcaggcggccggtgtgcggccggatgcggtgatcggccattcacagggtgagatcgccgcggcgtgtgtggcgggtgcggtgtcgatgcgggatgccgcccggatcgtgaccttgcgcagcgaggcgatcgcccggggcctggcgggccggggcgcgatggcatccgtcgccctgcccgcacaggatgtcgagctggtcgacggggcctggatcgccgcccacaacggtcccgcctccaccgtgatcgcgggcaccccggaagcggtcgaccatgtcctcaccgctcatgaagcgcgaggggtgcgggtgcggcggatcaccgtcgactacgcctcgcacaccccgcacgtcgagctgatccgcgacgaactgctcgacatcactagcgacagcagctcgcaggccccggtcgtgccgtggctgtcgaccgtggacggctcctgggtcgacagcccgctcgatgtggagtactggtaccggaacctgcgtgagccggtcggtttccaccccgccgtcggccagttgcaggccgagggtgacaccgtgttcgtggaggtcagcgccagcccggtgttgttgcaggcgatggacgacgatgtcgtcacggttgccacgctgcgtcgtgacgacggcgacgccacccggatgctaaccgccctggcacaggcctatgtccacggcgtcaccgtcgactggcccgccatcctcggcaccgccacaacccgggtactggaccttccgacctacgccttccagcaccagcggtactggctcaggagcgtggaccgggcggctgccgacggtcatccactgctgggcaccgtagtggacctgccggcctccgacggtgtggtgctcaccgggcgggtgtcgctggccacccatacatggctggccgatcacgcggtccggggcagtgtcctgctacccgggaccgcatttgtggacctggtcgtccgcgccgccgacgaggtcgagtccgacgtcgttgacgagttggtgatcgaaaccccgctcctgctgccgcagaccggaggcgtccaactgtccgtgtccgtcggcggagccgacgagtccgggcaccgcgcggtgatggtcttttcccaggcggacaacaccgatacctggacccggcacgtcacggcgacagtcagcacctctgactcgacggtgtcgctgccggagtttgcctcgtggccaccagcccaggcccggccggtgagcgtggccgacttctacgaccggctggctgcggcaggtaccgagtacggtcccgcgttccaggggctgcaggccgcgtggcgtgacggggacaccgtctacgccgaggtcgtcctcgctgaggagcaggcgcaggaggcggcacggttcgcggtgcatccggcgctgttggacgccgccatgcacgccagcgtcctgcacacacccgataccgaccagcagagcgtgcgtatgccgttctcctggaaccacgtccaaatccgagcgaccgacacagccatgctgcgcgtcgcggcaacaccgacaacagacggctggagtgtgcgggtcgccgacgacaccggcaggcccgtggccaccatcggttccctcgtcacccggccggtgacagccgacacactcggctccgctgccgatgacctgctcacgctggtatggacggagatcccgactccccagcagagcagcctgagcgtcggcaggtacgaggacctggcggacggtgacgtgccggtccccgacgtggcggtctacaccgcacgtcccgaggccgacggcagccctgatccgctggtacagactcgtacgctgaccgcccaggtgctccagacggcccaggcgtggcttggcggggagcgcttcaccgacagcacactggtcgtgcggaccggcaccgggctggccgccgccgcggtgtcagggctgatgcgttcagcccagtcggaacaccccggccgcttcgtcctggtggaaagcgacgacgacagcctcaccctccaccaactggccgctaccgtcggactggacgagccccgcctgcgggtcaacgacggccggttcgaagtgccacggctggcccgggtgaacgccgctgagcccgaatctgaaacggtgtgggacccgcatggcacggtcctgatcacaggcggctccggcgtcctggcaggcgccctcgcccgccacctggtcaccgaacgtggcgtacgtcatctcctgctgctgtcccgcaccactgccgacgaggggttgctcaacgaactcggcgagctgggcgctcgggtcgagacggcggactgcgacgtgtcggaccgtgccgggctggcgcgggtgctggcgggcgtatcaccggaacacccgctgacggcggtgatccaaaccgccggcgcactcgacgacggcgtcttggaaaccctgaccgcgcagcggctggacacggtcctacggcccaaagccgacggcgcctggcatctgcacgaactcactcgcaacaccggcctggccgcgttcgtcatgtattcctcggccgccggtgtcatgggtaatccggggcagggcaacctcgcggcggccaccgcgttcttggacgcgctggccgaccaacgtcgtgccgaggggctgcccgcactcgcactcgcctggggttcgtcagaagaaaccagtgacctgatcggtctgcggaccatctccgccgagcgtgggatgcgcctgttcgacagcgcatcgcatcgaggcgagccgcttctgatggccgcgtcgctggatccggcacgggccgcggaggttccggcgttgctgcgttcgttgcgtcgcccggtcgcccggcgggccgcttccgccgacggtggggtgcagtggctggccgccctggcaccggccgagcgggagaaggcgctgctgaaggtggtgtgtgacagtgccgccgtggtcctggggcacgccgacgcccgcaccattcccgtgaccggtgcgttcaaggatttgggcgtggattcgctgaccgcggtggagctgcggaacagcctggtgaaggcgacggggctgcggctgcccgccacgatggtgttcgactatcccaccccgaccgccttggctgctcggttggacgagttgttcaccggcgagaaccctgcaccggagaagagc

SEQ ID NO: 147 - DNA, 37 bp, Artificial Sequence
  Primer
agcttgctcttcgtgaggtcgatgtggtggtccactg

SEQ ID NO: 148 - DNA, 37 bp, Artificial Sequence
  Primer
tctacagtggaccaccacatcgacctcacgaagagca

SEQ ID NO: 149 - DNA, 41 bp, Artificial Sequence; identical to SEQ ID NO: 142
  Primer

SEQ ID NO: 150 - DNA, 41 bp, Artificial Sequence; identical to SEQ ID NO: 143
  Primer

SEQ ID NO: 151 - DNA, 48 bp, Artificial Sequence
  Primer
cgctggagcttgatcatgcgggcgcctcgggcgtgtcggggaagagct

SEQ ID NO: 152 - DNA, 48 bp, Artificial Sequence
  Primer
ctagagctcttccccgacacgcccgaggcgcccgcatgatcaagctcc

SEQ ID NO: 153 - DNA, 28 bp, Artificial Sequence
  Primer
gcaggaaagaacatgtccacgggtgcgc

SEQ ID NO: 154 - DNA, 30 bp, Artificial Sequence; identical to SEQ ID NO: 116
  Primer

SEQ ID NO: 155 - DNA, 37421 bp, Artificial Sequence
  Plasmid
tatgtgtcctccttaattaatcgatgcgttcgtccggtggtcgtcgtcatcgtcggccccgtggctcgaaggaggctcgaaggccgatacgggacccctcgatgccggatccaccggcgccgcgtccagcggcaccccatctcccttcgaccgccgctcgagccgggcgcccaaagctgagcgcgtgagggaccacgaggcagggaggggaacacttaagaggggctccaccgcgttcacggaccggtgctacacgagcaccttctcaccgttgagaatttccatgtgcatacgctggatttccggcgtcggatccacccccagttcgtcggacagtatccgccggagattccgatacgattccagcgcctcggcgcgcctgcccatctgacagagcgcgcccatcagtttggcgtgcagggtctcgttcagcggatgcgaaattaccagggaccggagttccggaatcatcggccctattctgcccagccgccaattcgcgtcgatacggagctgcattccaaaaagccgcagctcttccaggtgcgcgatattgctttcgagcacccggccgcacggtacggtggacagcgccgggcctcgccagagatccagtcccgcgtccaacgaggcgagcgcctcctcgagccggttctcctcgagcagccggccgccggtgcggatcagacgctcggcgaccgcgacgtcgagttcgtcctcgtcgatcagggcgaagtagccgggcggctgggtcaggaccaattcccggtcgtcgctcgtcacccggtgctcccccagcagccggcgggtgtggtacacgtacgtctgcagcgtcgtcatggcgctgcggggcgggtggtccgcccacaactcctcgatgagcacccccgatcccaccacctcgtgccgcctgaggagcagcagcaccaggagctgggtcgccttcgaggatttaagcggaattacacatcccgcatcggtgattacatggacacgtcccaataagttgaatctcatctgcgcccccgtcgagattctccgtctcctgggggcgacaataacaggcctactcaacagatttcaatgtgcttgccgtcacaagcgatctcctattgatcaaaaattaatcagtgcagcgagctgcactgattaatttttgctggattttaccgagaggcagtggactagtttactggcgtaatagcgaagaggcccgcaccgatcgcccttcccaacagttgcgcagcctgaatggcgaatggcgcctgatgcggtattttctccttacgcatctgtgcggtatttcacaccgcataaattccccaatgtcaagcacttccggaatcgggagcgcggccgatgcaaagtgccgatcaacataacgatctttgtagaaaccatcggcgcaggtatttacccgcaggacatatccacgccctcctacatcgaagctgaaagcacgagattcttcgccctgcgagagctgcatcaggtcggagacgctggccaacttttcgatcagaaacttctcgacagacgtagatcaggcttcccgggtgtctcgctacgccgctacgtcttccgtgccgtcctgggcgtcgtcttcgtcgtcgtcggtcggcggcttcgcccacgtgatcgaagcgcgcttctcgatgggcgttccctgccccctgcccgtagtcgacttcgtgacaacgatcttgtctacgaagagcccgacgaacacgcgcttgtcgtctactgacgcgcgcccccaccacgacttagggccggtcgggtcagcgtcggcgtcttcggggaaccattggtcaaggggaagcttcggggcttcggcggcttcaagttcggcaagccgctcttccgccccttgctgccggagcgtcagcgctgcctgttgcttccggaagtgcttcctgccaacgggtccgtcgtacgcgcctgccgcgcggtcttcgtacagctcttcaagggcgttcagggcgtcggcgcgctccgcaacaaggttcgcccgttcgccgctcttctcaggcgcctcagtgagcttgccgaagcgtcgggcggcttcccacagaagcgccaacgtctcttcgtcgccttcggcgtgcctgatcttgttgaagatgcgttccgcaacgaacttgtcgagtgccgccatgctgacgttgcacgtgccttcgtgctgcccaggtgcggacgggtcgaccaccttccggcgacggcagcggtaagagtccttgatcgattcttccccgcgcttcgaagtcatgacggcgccacactcgcagtacagcttgtccatggcggacagaatggcttgcccccgggaaagccccttgccgcgccccctgccgtccaaccacgcctgaagctcataccactcagcgggctcgatgatcggtccgcaatcaagctcgaccggccggagcgtgatcgggtcgcgctgaatgcggtaaccctcaatcttcgtggtcggcgtgccgtccggcttcttcttgtagatcacctcagcggcgaagcccgcaatacgcgggtcccgaaggattcgcataacggttgccgggtcccaggcgcttgaagcggtcttcttcccaatcgtctcgccccgggtcggcacggcgtcagcgtccatgcgcttacaaagccccgtgatgctgcccgggtgaatggcggcttgactgcccggcttgaagggaaggtgtttgtgcgtcttgatctcacgccaccaccaccggattacgtcgggctcgaactcgaagggtccggtaaggggagtggtcgagtgcgcaagcttgttgatgacgacattgaccattcggccgttgcgcgtgatctccttcgtctccgaaacaagctcgaagccgtaaggcgccttcccgccgacgtacccgcccaattcgcgctgaaggttcttcgtgtcgagaatcttcgccgacttcagcgaagattctttgtgcgacgcgtcgagccgcataatcaggtgaatcaggtccatgacgtttccctgccggaagacgccttcctgagtggaaacaatcgtcacgcccagggcgagcaattccgagacaatcggaatcgcgtccatgaccttcaggcgcgagaagcgcgacacgtcatagacaatgatcatgttgagccgcccggcgcggcattcgttcaggatgcgttcgaactccgggcgctccgccgtcccgaacgccgacgtgcccggcgcttcgctgaaatgcccgacgaacctgaaccggcccccgtcgcgctcgacttcgcgctgaaggtcggccgccttgtcttcgttggcgctacgctgtgtcgctgggcttgctgcgctcgaatttcgcgctcgcgcgactgacggtcgtaagcacccgcgtacgtgtccaccccggtcacaaccccttgtgtcatgtcggcgaccctacgcccccaactgagagaactcaaaggttaccccagttggggcactactcccgaaaaccgcttctgacctgggaaaacgtgaagccccggggcatccgctgagggttgccgccggggcttcggtgtgtccgtcagtacgggccatagaggggcgtcgtgtaacccacccagggcgattgctccggcacggggaagccgcgccacgccttcgggacgtcatggcaatcgctagagcttgcatgcctgcaggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctggcggcctgctgaaactctggctcaccgacgacccgcgcacggcgtggttcggtgatgccacgatcctcgccctgctggctgaagatcgaagagaagcaggacgagcttggcaaggtcatgatgggcgtggtccggccgagggcagagccatgacttttttagccgctaaaacggccggggggtgcgcgtgattgccaagcacgtccccatgcgctccatcaagaagagcgacttcgcgaagctggtgaagtacatcaccgacgagcaaggcaagaccgatccccggggacctgcaggtcgactctagctagctggccagggcccgatacgtcgcggtgagttcaggctttttcatatctcattgcccccggacgagcgtctgctccgccattcgccgtccgccgtgccaatcggatcagccgtccaaatgcgggattttcgttagtcggaggccaaacggcattgagcgtcagcatatcatcagcgagctgaagaaagacaatccccgatccgctccacgtgttgccccagcaatcagcgcgaccttgcccctccaacgtcatctcgttctccgctcatgagctcagccaatcgactggcgagcggcatcgcattcttcgcatcccgcctctggcggatgcaggaagatcaacggatctcggcccagttgacccagggctgtcgccacaatgtcgcgggagcggatcaaccgagcaaaggcatgaccgactggaccttccttctgaaggctcttctccttgagccacctgtccgccaaggcaaagcgctcacagcagtggtcattctcgagataatcgacgcgtaccaacttgccatcctgaagaatggtgcagtgtctcggcaccccatagggaacctttgccatcaactcggcaagatgcagcgtcgtgttggcatcgtgtcccacgccgaggagaagtacctgcccatcgagttcatggacacgggcgaccgggcttgcaggcgagtgaggtggcaggggcaatggatcagagatgatctgctctgcctgtggccccgctgccgcaaaggcaaatggatgggcgctgcgctttacatttggcaggcgccagaatgtgtcagagacaactccaaggtccggtgtaacgggcgacgtggcaggatcgaacggctcgtcgtccagacctgaccacgagggcatgacgagcgtccctcccggacccagcgcagcacgcagggcctcgatcagtccaagtggcccatcttcgaggggccggacgctacggaaggagctgtggaccagcagcacaccgccgggggtaaccccaaggttgagaagctgaccgatgagctcggcttttcgccattcgtattgcacgacattgcactccaccgctgatgacatcagtcgatcatagcacgatcaccggcgctgttgcaaatagtcggtggtgataaacttatcatccccttttgctgatggagctgcacatgaaccaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagatttctagcttggattctcaccaataaaaaacgcccggcggcaaccgagcgttctgaacaaatccagatggagttctgaggtcattactggatctatcaacaggagtccaagctcagctaattaagcttagtgatggtgatggtgatgagatctggtctagattcaggccgtgggatcaccgaactcccgatcgatgaagtcaaggatttcgctggcactcgcactcgagagggcggtagtggaaacctcttcggggctcgaaatccgctgccatttattcagaaccgacgacagccgatccttgatcgcggatgcctgtcgatcgtcgaaggtcacggacgtgaacatcttttctatgcgatcgatctcggcgagcagggtcgtcgactgaaccctcgggttcatgaggtcgcccagccgggcggccaggtctgccggggtcgggtagtcgaacaccattgtggcgggcagccgcaggcccgtggccttcgtcagactgttgcgcagctccaccgcggtcagcgagtccacacccaaatccttgaacgcaccggtcgccggaatactgcgggcgtcggcatgtcccagaaccgtcgcggcgctgtcacgcaccaccttcagcagtgccttcgcccgctcctccggcgccaagccgaccagccactgcgccgacgaatcaccggtggaggcggcccgccgggcaaccgggcggtgcaacaaacgcagcaatgccggaacctcgacctcccgcaccggctccatcggcgtggccaccagaaccggttcaccctgacgtgaggcgatgtcgaacagccgcatcccgcgctcggcggtgatggttcgcagcccgctgcgccggatccggtcatggtcggtaccggtcagcttcgcggtcaggccgctggcgtcctcccacaggccccaggccagcgcgagggccggcagaccctcagcacgacgctgctcagccagcgcgtccacgaacgcgttcgccaccgcgtagttaccctgccccgcactaccgagcacaccggcagccgaggagtacatgacgaacgcggcaaggtcgatatcgcgggtgagctcgtgcaggttccacgcaccatccgccttgggccgcagcacggtgtccagccgccgcgccgtcaacgattccacgacgccgtcatccagcacacctgcggtgtgaatcaccgccgtcaatggatggtccggcgacacacccgccagcacccgcgccagcccggcacggtccgacacgtcgcacaccgccgtgtccaccaccgcggcacccaactcggccagctcgctgatcagcgcctcgtccggggcgctgcgggacagcaacagcagatgacgcacaccgcgttcggccaccaggtgccgggcggcgatccccgccagcacacccgaaccaccggtgatcagaaccgtgccatccggatcccagacgccttcaggctcaggctcagcgacgcccgtacgagtcagtcgcggtgcctcgtaccggccgtcgatgacccgcagccgcggctcatcgagcccgacggtggcggccagttggtccggggtgagggtgtcgtcgtcactttccaccaggacgaaccggcccgggtgctccgactgagccgaacgcatcaaccccgacaccgcggctgcggccaaaccagttccggtccgcacaaccagcgtactgtcagtgaaacgctcccccgccagccacacctgcaccgcctgcagaacctcagcggtcagccgacgagtctgtgccagcgggtcaccgctgtcggggagtgcggtgaacacaacgacatcgggcatcggcacctcgccgtccgcgaggtcttcaaacttgcccaccgtcacgccgacctgctgggagaccgggatctccgtccacgtcagggcgaacagatcatcgacagcagaaccgagcgcatcggctgccaccggacgggtcaccagcgagccgatggtggccaccggccgaccgatgtcatcagcgacccgcacaccccagccatccgcgacccgtgtcatcgcgacccgcagcgtggccgagccagtgacatggacctggacgtggttccaggagaacggcaaccgcacggtgtcgcggtcggcatcgggtgtgttcaggatcccggcgtgcagggcggcatccaacaccgcagggtggacggcgaatcgtgccgcgtcctgggtctgctcctcagccagagcaacctcggcgaagacggtgtcaccatcacgccacgcggcctgcaaaccctggaaggcaggtccgtactcgtaacccgccctggtcagctggtcgtagaagcctgccacgtccaccggcttggcctgcgcaggtggccacgcggtgaggtccgacgttggcacagtcgtgtcggacacgctgacggtggcggaaacgtgccggacccaggcatcggcgctgtccgcccgggagaagaccgtcaccgcgcggtgtccggactcgtcggcctcgccgacggatacggacagttgcacaccgccggtctgcggcagcagaagcggggcttcgacgatcagctcgtcaacgacgtcgcaggccacctcatcagccgcgcggacaaccagctccacaaacccggtaccgggcagcaggacactgccccggaccgcgtgatcagccagccacgcgtgggtggccagtgatacccgcccggtcagcatcacaccatccgaacccggcatcgccagcaccgcacccagcaacgggtggcccaccgcatccagacccgccgccgacacatcggcagaccggccggcctcagcccaataccgctggtgctggaacgcgtacgtcggaagatccagcacccgtgttgccgggacatcacccagcaccgcgcgccagtcgacagtcacgccgtggacataggcctgtgccagggcggtgagcatccgggtggcgtccccgtcgtcacgacgcagcgtggcaaccgtgacgacatcgtcgtccatcgcctgcatcagcaccgggctggcgctgacctcgacgaagacggtgtcgccctgggcctgcaactggctgacggcggggtggaaaccgaccggctcacgcaggttccggtaccagtactccccgtccagcgggctgtcgacccaggtgccgtccacggtcgacagccacggcacgagcgggtcctgcgagctgctgtcgctagtgatgtcgagcagttcgtcgcggatcagctcgacgtgcggggtgtgcgaggcgtagtcgacgtgatccgccgcacccgcacccctttgcctcagagcggtgaggacatggtcgaccgcttccggggtgcccgcgatcacggtggaggcgggaccgttgtgggcggcgatccaggccccgtcgaccagctcgacatcctgtgcgggcagggcgacggatgccatcgcaccacggcccgccaggccccgggcgatcgcctggctgcgcaaggtcacgatccgggcggcatcccgcatcgacaccgcacccgccacacacgccgcggcgatctcaccctgcgaatggccgatcaccgcatccggccgcacaccggcggcctgccacaccgcggccagggaaaccatcaccgcccaggaagcgggctggaccacatcaacccggtccaccaccgccggatcatccagcacggcgaacagatcccagtccacaaactcactcaacgccgccgcgcactcggccatccgctcggcgaacaccaccgacgaatcgcgcagtgcactgcccatccccagccactgccatccctgcccgggaaagacgaacacgatcctggggtcggacaccgcggtgccggtgacggtctcatctccaaggagtacggcgcggtgctcgaacaccgaccgtgtcaccgccagcgtcgatgccacagcccgtatatccactccgggcgacgccgccaggtaggcgcggagccggtcttcgtgttcggtcagggcgggctgggtcttggccgatatcaccagcggcaccagttccgaaaccagtacgggtgtagagccagccgtgtcgcccacagactgtgccggtgcactctcaaggatgacgtgggcgttagtgccactgatcccgaacgacgacacacctgcccgacggggtcggccggtctccggccacggctggttctccgccaccagctcgaccgcacccgccgaccagtccacatgccgcgacggctcatccacatgcaacgtgcgcggcaccatgctgtgctgcagggccatcaccatcttgatgacacccgacacacctgcggcagcctgggtatggccgacgttcgacttcagcgatcccagcagcagcggctccccgcggccctggccgtaagtagcgatcaccgcctgggcctcgatcgggtcacccagcgtcgtacccgtgccgtgcgcctcgaccacatccacctcgtgcggcgccaggccggcgttgctgagagcggcccggatcacccgctgctgcgaaggaccgttcggcgcggacaggccgttcgacgcaccgtcctggttcaccgccgagctacggaccaccgccaatatctggtgaccgttggcctgagcatccgacaaacgctccaccaataggacgccgacgccctcagcccaccccgtgccgtccgcggcgtcagcgaacgccttgcaccggccatcggctgacaagcctcgctgccgcgagaactccacgaaagtctgcggcgtgggcatcacggtcacgccgccgaccagggccagcgaacactcaccctgtcgcagggcataccccgcctgatgcaacgccaccagcgacgacgaacacgccgtgtccaccgtgaacgcgggaccttcgagaccgaagaagtacgacacccggcccgacaacacactcgccgcaccagcagttgtcccgaagccgccgaggtcggcaccgatgccgtagccaccggggtaagcacctatgaagacgccggtgtcgctgccgcgtacggaaccgggctcgatcccggcccgctcgaacgcctcccaggacacctcaagcatcaaccgctgctgcggatccatcgccaacgcctcacgcggactgatcccgaagaacgaggcgtcgaaaccggccgcggcatccaggaagccgccctgcacgctgtaggacttcccgggcgcgtccgggtccggatcgtacaggttctcgacgtcccagccgcggtcggttgggaagccggaaatcgcgtccgtaccggactcgaccaagcgccacagatcctccggcgacgagactccaccgggtaggcggcaggccattcccacgatcgccagcggctcgtcctgcgccaccgccgacactggcccgcgcaccggagcggggttctcgccggtgaacaactcgtccaaccgggcagccagggccgtcggggtggggtagtcgaacaccagcgtggcgggcagccgcagctccgtggccttcgccaggctgttgcgcagttccaccgcggtcagcgaatcgatgcccagatccttgaacgccgtggttgccggaatcgtgctggtgtcggcgtgtcccagaaccgtcgcggcgccgtcagacaccagcttcagcagtgccttctcccgctcggccggtgccagggcggccagccaccgcgctccaccggcggcagcggcccgccgagcgaccgggcggtgcaacgaccgcagcaatgccgggacttccgcgtcccgtaccggctccatcggcgcggccaccagaaccggttcactgtggcgtgacgcgctgtcgaacagccccatcccgtgctcggcggagatggcccgcaggccaccgcgccggatccggtcacggtccgtgtcggtcagttgcgcggtcaggccactggcgtcctcccacagaccccaggccaccgccagcgcgggcagaccctcagcgtgacgctgctcagccagcgcgtccaggaacgcattggccgccgcgtagttgccctgtcccccactgccgagcacaccagcggcggaggaatacatgacgaacgccgccaggtcggcatcccgggtgagctcgtgcaggttccacgcaccgtcggccttgggccgcaacaccgcgtccagccgctgcgcggtcagggactccaccacaccgtcatcgagtacgcccgcggtgtgaatcacggccgtcaggggatgctccggtgacacacccgccagcacctgggccagcgcggcacgatcggacacgtcacaggccgctgtctcgacccgggcccccagttcgccgagttggttgatcagtgcctcgtccggggcgctgcgggacagcagaaggagatgacgcacgccgcgttcggtcaccaggtgccggacggcgatccccgccagcacacccgaaccaccggtgatcagaaccgtgccatccggatcccacaccttctctgactcgggttcagcggcatgcgtacgggtcagtcgtggcgcttcgaagcggccgtcgctgatccgcaggcgcggctcatccaacccgaccgccgccgccaactgatccagagcgagggcatcgtcatcactctcgaccaggacgaaccggccggggtgttcggactgggccgaccgcatcaaccccgacaccccagcagcggccaaaccagtaccggtccgcaccaccagcgtgctgtcgctgaagcgctccccgccaagccactcctgaactgcctggaggacctgaccggtcagctttcgtgtttgctccagcgggtcgtcgtcgttgtcggggagtgcggtgaagaccgccacctcgggtaccggcacatcgccgtccgacaccagctcctcgaaccggccgaccgtcagtccggtcccctcaggggccgggatctccgcccaggtcaaggcgagcaggtcatcggcagcggaaccgagcgcgtcggccgtcaccgggcgcgtcacgagcgaacccacgttagccaccggccgaccgatctcatcagcgacccgcacactccagccatccgccgcctgcgtcaccgcgacacgcaacatggccgaaccaccagcatggacccgaacaccgtcccaggagaacggcagccccacacccacctcggcatcggcgcattcaagggtgcaggcatgcagagccgcatccagtagagccggatgcacggagggatatcgcgccgcctcccggacctgctcctcagccagagcaacctcggcgaagacagtgtccccataacgccacgcggcctgcaaaccctggaacgcgggaccgtactcgtacccttctgccatcagcgggtcgtagaagcccgtcacgtccaccggctgtgcctgagctggtggccacgaggcaaactccgacagcgagaccgtcgagtcagaggtactgatcacggcggaaacgtgccggacccaggtatcggcgttgtccgcccgggagaagatcgtcaccacccggtgtccggactcgtcagcctcaccaaccgataccgacacctgcacaccgccggtctgcggcagcagaagcggggcttcgacgatcagctcgtcaacgacgtcgcagcccacctcatcagccgcgcggacaaccagctccacaaacccggtaccgggcagcagcacactgccccgcaccgcgtgatcagccagccacgcatgcgtggccaacgacacccgcccggtcaacagcacaccatccgaacccggcaacgccaccaccgcacccagcaacggatgccccaccgcatccagacccgcccccgacacatcggcagaccggccgacctcagcccaataccgctgctgctggaaggcgtacgtcggaagatccagcacccgggttaccgggacatcacccagcagcgcggtccagtcgacggtgacgccgttgacatacaggtgggccagggcgccgatcgcggcctgggtttcgtggtcgccgtgcagcatcgcgacgccgtcgaccaggcgggccagtgaccggtcggcacccagctcgacgaacacggcgtcctcgtatgaggccacctgctcgccgaaccggaccgtatcccggacctgccgcacccaatactcagccgtcatcacccgatcaccagcggccatcacgacaccaggtgcgtgataggtcaggccttgagcgaccgcccggaactcctccagcatcggctccatacgggcggaatggaacgcgtgactggtcgccagccgcgtccacttccccagcccctccgcggcctgcagcacagcggcctcatcaccggagagaaccaccgacgacgggccgttgaccgcggcgatctccacaccctcacccagcacggcccgagcctcatcctccgagaccgggacagcgaccatcaccccacccgcaggcagagcctgcatcagacgagcccgcgccgacaccaaagtgcaggcatcctccaacgaccacaacccggacacgtacgcagccgcaagctcacccaccgaatggccgatcaccgcgtccggccgtacaccccacgattccagcaacccgaacagagccacctgcaaagcgaacaaagccggctgggcgtaaccggtctcattcacctccagatcgggcacatcgagcaggtcccacacctgctgatggatccgcgcgaagacggggaacgcggcggccagttccgcacccataccagcacgctgcgacccctgccccgggaagacgaacaccacccgcggatcggtcgccgcggtcccactaacagtgtcatcacccacgatcaccgcacggtgctcgaacaccgaccgtgtcatcgccagcgtcgatgccacagcccgcatatccaccccgggcgacgccgccagatacgcacgcaaccggccctcgtactcagccagtgccgactgcgtcttggccgaaatcaccaacggcaccaactccgaggccatcaccgacgccaccaccggcgcatccgcaggccgcacatcgtccacggcctgcgtggggggtgcgctctccaggatgacgtgggcattagtgccactgactccgaaggacgacacgcctgcccggcgcggccgaccggcttcgggccaggactggttctccgtcaccagctcaaccgcgccatccgtccagtccacatgccgcgacggctcatccacatgcaacgtacgcggcaccagaccgtgctgcagcgccatcaccatcttgatgacacccgacacacccgcggcagcctgcgtatgaccgacgttcgacttcaccgaacccagcagcacaggctggtcacgatcctgaccgtaggtcgcgatcaccgcctgggcctcgatcgggtcacccaacgtcgtacccgtgccgtgggcctcgaccacatccacctcggccgtggtcaggcccgcgttggccagcgcctgccggatcacccgctgttgcgaggggccattcggcgcggacaggccgttcgacgcgccgtcctggttgaccgccgagctgcggaccactgccaatacctggtggcccttggcctgagcgtctgacaggcgctcgaccagcaggacgccgactccctcagaccatcccgtgccgtccgcgctgtcggcgaacgccttgcaccggccatcggatgccaggccacgctgccgggagaactccacgaaggtatgtggtgtggccatcacggtcacaccgccgatcagggccagcgagcactcaccctgtcgcagggcataccccgcttggtgcagggcgaccagcgacgaggaacacgccgtgtccaccgtgacggccggcccctcaagaccgaagaagtacgacagccggccggacagcacgttgaggccagcggtcgcaccataaccttcgaggtctgcgccgatgccgtaaccgcccgggaaagcgcccatgaagacgccggtgtcgctgccgcgtacggaaccgggctcgatcccagcccgctcgaacgcctcccaggacacctccagcaccagccgctgctgcggatccatcgccaacgcctcacgcggactgatcccgaagaacgaggcatcgaagttggcagcggtcgccaggaagccaccctctacgcagtacgacttcccggccgcatccggatccgagtcgaacaggttctccacgtcccagccacggtcggtggggaaaccggaaatcgcatccgtacccgattccacaaggcgccacagatcctcaggcgacgacaccccaccaggcaggcggcaggccatgcccacgatcgccaacggctcgtcctgccccaccgccgacaccggcgtgcgtacctgaacaggattctcgccggtgaacagctcctccaaccgggcggccagggcacctggggtcgggtagtcgaacaccaacgtggcgggcagccgcagtcccgtggccttcgtcaggctgttccgtagttccaccgccgtcagcgaatccacgcccagatccctgaacgcggcggtcaccggaatactgtcgacgtcggcgtgtcccagaaccgtcgcggcactgtcacacaccaccttcaccagtgccttcgcccgctcctccggcgccagagcggccaggcaccgcaccgcaccgccggaggccgcccgccgggcgaccgggcggtgcaacgaccggagcatcgcggggacttcggcttcccgtaccggctccatcgccgcggccaccagaaccgggtccctgcggcgtgacgcgccgtcgaacagccgcattccatgctcggcggagatggcccgcatgccgctgcgccggatccggtcatggtctgtatcggtcagattggcggtcaggccgctggtgccctcccagaggccccaggcgagtgcgagtgcgggcaggccctcggcacgacgttgctctgcgagagcgtccaggaacgcgttcgccaccgcatagttgccttgccccgcgctaccgaatacaccggcggccgaggagtacatgacgaacgcggccaggtcggcgtcacgggtgagctcgtgcaggtgccaggcaccgtcggccttgggccgcagtaccgtgtccagtcgctgcgcggtcagggactccaccacaccgtcgtccaccacacccgcggtatgaatcaccgccgtcaggggatgctccggtgacacgtccgccagcacccgcaccaacccagggcgatccgatacgtcgcaaaccgctgtggccacctgggcgcccagttcgccaagctcgctgatcagtgccccgtccggtgcgctgcgggacagcagcagcagatgacgcacgccacgctcggccaccaagtgccgggcggcgatccccgccagcacacccgaaccaccggtgatcaggaccgtgccatccggatcccacaccttttctgactcgggttcagcggcatgcgtacgggtcagtcgtggcacttcgaaccggccgtcgctgatccgcagccgcggctcatccaattcgacggtcgccgccagctggtcgggggcgagggtgtcgtcgtcgctttccaccaggacaaaccggcccggatgttccgactggcccgaccgcatcagacccgacaccgcggcagccgccaagccagtgccgatccgcacaatcagtgtgctgtcggtgaagcgttcctcggccagccacgcctggatcttctgcaggacctgggcggtcagcgtacgagtctgggccagcgggttctcgctactgtcggggcgtgcggtgaagaccaccacctcgggcaccggcacatcggcgtccgccaggtcttcgaagcggcctatggtcaggctggtctcctgaggggccgggatctccgtccacgtcagggcgagcaggtcgtcggtggtggagccgagtgtgtcggccgtcaccggccgagtcacgagggagccgatggtggccaccggccggccggtgtcatcagcgacccgcacactccagccgtccgccgcctgtgtcacggcgacgcgcaacatcgccgagccgaccgcgtggacctgaacctggttccaggagaacggcaaccgcacgccctgctcggtgtcgggcgtgttcaggatcccggcgtgcagggcagcatccagcaacgcgggatgcacggcgtttcgggccgcgtcctgcgcttgctcttcggcgagggcgacctcggcgtggacggtgtcgccgtcacgccacgcggcctgcagcccctgaaacgcgggaccgtactcgtaggccaccacggtcaactgatcgtagaagtcggccacgttcaccggctgggcctgggcaggtggccacgcactgaggtctggcagcgagagggtcgtatcagagttgctgaccgtgaccgtggcgtgccgcgtccaggtatcgacgttgtccgcccgggagaagaccgtcaccgcccggcgtccggaatcatcggactcggcgaccgcgacggacagttgcacgcctccggtctgcggcagcaggagcggcgtctcgatcaccagctcgtcgatgacgtcacaaccgacctcgtcggcggcgcggacgaccagctccacaaacccggtaccgggcagcagcacactgccccgcaccgcgtgatcagccagccacgggtgcgtggccaacgacacccgcccggtcaacagcacaccatccgagccgggaaccgccaccgcctcacccagcagcggatggccgcccgcggccatccggtccgtgccctcgagccagtagcgctggtgctggaaggcgtacgtcggaaggtccagcacccgtgttgccggagcatcgcccaggagcgcgggccagtcgacggtgacgccgttgacgtacaggtgggccagggcactgacagcggcctgcgcctcgtggtcgccgtgcagcatcgcgacgccgtcgaccaggcgggccagtgaccggtcggcacccagctcgacgaacacggcgtcctcgtacgaggccacctgctcgccgaaccggaccgtgtcccggacctgccgcacccagtactcagtggtggtcaactgatcaccagcggccatggagacctgcggcgtccggtaggtcaggccttcggcgaccgcccggaactcctccagcatcggctccatacgggcggaatggaacgcgtggctggtcgccagccgcgtccacttccccagcccctccgcggcctgcagcacggcggcctcatcaccggagagaaccaccgacgacggcccgttgaccgcggcgatctccacaccctcacccagcacggcccgggcctcatcctccgagaccgggacagcgaccatcaccccacccgcaggcagagcctgcatcagacgagcccgcgccgacaccaaagtgcaggcatcctccaacgaccacaacccggagacgtatccggcggcgagctcaccgacagagtgaccgaccaccgcatccggccgtacaccccacgattccagcaacccgaacagagccacctgcaaagcgaacagggccggctgggcatacccggtctcgttcacctccagatcgggcacatcgagcaggtcccacacctgctgatggatccgcgcgaagacggggaacgcggcggccagttcctcacccataccagcacgctgcgacccctgacccgggaagacgaacaccacccgcggatcggtcgccgcggtaccggtgacggtgtcatctcccagcagcacggcccggtgctcgaacaccgaccgtgtgatcgccagcgtcgatgccacagcccgcatatccaccccgggcgacgccgccagatacgcacgcaaccggccctcgtgctcagtcaaagccgactgggtcctggccgaaatcaccatcggcagccactccggtgcccgctcgatcaccgcgttgtccgcaggctgagtggggggtgcgctttccaggatgacgtgggcgttggtgccactgatcccgaaggacgacacgcctgcccggcgcgctcggcccatatccggccacggctggttctccgtcaccagcgcaaccgcgcccgccgaccagtccacatgccgcgacggctcatccacatgcaacgtacgcggcacgaaaccgcgctgcagcgccatcaccatcttgatgacacccgacacacccgcagcagcctgcgtatgacccagattcgacttcaccgaacccagcagcaacggctgctcacgatcctggccataggtcgccagcaacgcctgggcctcgatcgggtcacccagcgtcgtacccgtgccgtgcgcctcgaccacatccacctcgtgtgccgcaaggccggcgttgctgagggcagcctggatcacccgctgctgggaagggccattcggcgcggtcagaccgttcgacgcaccgtcctggttgaccgccgaactgcgcagcatcgccagcacctggtggcccttggcctgagcgtccgacaaacgctccaccaacaacacaccgacaccttcggagaagccggcgccgtccgcactgtccgcgaacgccttactgcgaccgtcaccggccaggccaccctgacgagcgaactccacgaaagtctgcggcgtggccatcacggtgacaccaccgaccagggccagcgaacactcaccctgccgcagggcataccccgcctggtgcaacgccaccaacgacgacgaacacgccgtgtccaccgtgatggcagggccttcgaggccgaagaagtacgacacccggccggacaggacactgaccgcgctcgcggtggcgccgaagccgccgaggtcggcaccgatgccgtagccaccggggtacgcacccatgaaaaccccggtatcagttccgcgtacggaaccgggctcgatcccggcccgctcaaacgcctcccaggacacctccagcaccaaccgctgctgcggatccatcgccaacgcctcacgcggactgatcccgaagaacgaggcatcgaaaccagccgcggcatccaggaaaccaccctgcaagcgataggagtcgccagctgcggggccgaacagattctccacatcccagccacgatcggtggggaatccggagaccgcgtccgtacccgactccagaagacgccacagatcctcaggcgacgacaccccacccggcaagcgacacgccatgccgacaatcgccaacggctcgtcctgcgccaccaccgacaccgacgtacgtaccggaacaggagtttcaccgacgaaccactcccccagccgggctgccaaggccgtcggggtggggtagtcgaacaccagcgtggcgggcaaccgcagccccgtggccttcgtcaggctgttccgcagttccaccgcggtcagcgaatcgatgcccagatccttgaacgccgcggtcgccggaatcgtgctggcgtcggcatgtcccagaaccgtcgcggcgccatcacacaccagcttcagcagcgccttctcccgctccaccggcgccaaccgggccagccactgcaccgacgagccgccggtagaagcagcccgccgggcaaccggacgatgcaacaaacgcagcagcgccggaacctcggcctcacgcacaggctccatcgccgcagcgagcagcaccggctcaccatgacgtgacgcggcatcgagcaagcccatcccatgccccgcggagatcgcccgcaggccaccacgccggatccggtcacggtccgtgtcagtcatttcggcggtcaggccgctggcgtcctcccacagaccccacgccaccgccagcgcgggcagcccctcaccacgacgctgctcagccaaggcatccaggaacgcgttggccgccgcgtagttgccctgtcccccgctgccgagcacaccggcggcggaggagtacatgacgaacgccgccaggtcggcgtcccgggtgagctcgtgcaggtgccaggcgccgtcggccttgggccgcagtaccgtctccagctgctgcgcggtcagggactccacgacgccgtcgtcaagtgcgccggcggtgtgaatcaccgcggtcaacggatgctctggtgatacaccggcgagtatccgtgccagcccggcacgatcggacacgtcgcagatcgccgtgtcgacccgggcgcccagctcaccgagctcgttgatcagcgcatcgtccggggtactgcgggacagcagcaggagatgacgcacaccctgctcggccaccagatgccgggccgcgatccccgccaggacacctgaaccaccggtgaccagaaccgtgccgttggcgtcgagttgctgagggacggtgaggacgatcttgccgatgtggcgggcacggctcatccagctgaacgcctcacgggcctgacggatgtcccaggcccgcaccggcaggggcaatagcacaccctgcgcgaacagggcgagcaaatcggcgatgatctcccgcagccggtccggaccggcgtccatcagatcgaacgcctggtagctggtacccggccggtcggcggtgacctggtgcgggtcacggatgtcggtcttgcccatctcgacgaaccggccaccacgaggcagcagatcaagcgaggcatcgacaaagtcaccgctgagggagttcaggacgacatcgacaccccggctgtcagtggtgtccagaaccatttcccggaagccagtggtacgcgagtccccgatccgggcatcctccagacccgcctcgcgcaggacgtgctgcttaccggtgctggccgtcgcgtagatccgcgcgccgaggtggcgggcgatctgggtggctgccatgccgacaccacccgcggcggcgtggatcagcacagactcacccgcactcagcccggccagatccaccagcccgtaatacgcggtggcgaacacaaccggcacggacgccgccgtagtgaacgaccacccgtcaggaatcacacccagcattcggcgatcagcgatcgcgaccgccccgaacccaccgcccacaagaccgaacactcggtctcccggggccagatcctggacctccggaccgacctcgagcaccacgcccgcagcctcagccccgatcacagcctcaccggggtaagtgccgagcgcgatgagaacatcgcggaagttcaggcctgcggcgcgtacgtctactcgtacttcaccggattgcaggggccgttcggcggtttcggcgggtaccagcgcgaggtcccgtaaggttccgctgtgggactgctccagcagccacgcacgatccccgggaatcgtgagcgggctgctttccggcgtattcgcccgcgccagccgcggtacctcgaaccggccgtcgcagacccgcagccgcggctcgtccaacccgacagtcgcggccagttgctggagggtgaggttgtcgtcgcattccaccaggacgaaccggccggggtgttccgactgggcagaccgcatcagacccgacaccccggcggtggccagcccggtgccggtccgcacgaccagcgtgctgtcggtgaaacgttccccggccagccatgcctgaactgcctggagaacctgggtggtcaacgtgcgggtctgtaccagcggatccggcggatccagcggggctagcgggttctcgctgctgtcggggagtgcggtgcagaccaccacctcgggcaccggcacatcaccgtccgccaggtcttcgaaccggccgacgctcaggccggtctgctggggggtggggatctccgtccagaccaccgtgagcaggtcgtcggcagcggaaccgagcgtgtcggccgttaccggccgcgttacgagcgagtcgacggtagccaccggtcggccgctgtcgtcggcgacccgcacactccagccgtcactggttgggttatccgcaacgcgtagcgtggccgatccagtggcccggacctggacaccgttccaggagaacggcaaccgcacaccctgctcggcgttgtcgagtgtgttcagaattccggcgtccaaggcggcgtccaacagcgccggatgcaccgcgaaccgtgccgcctcctccgcctgctcctcggccagggccacctcggcgaagacggtgtccccgtcacgccacgcggcctgcagcccctggaacgcgggaccgtactcgtaaccggccccggtcagccggtcgtagaaatcgcccaggcccaccggctgtgcctgtgcgggaggccaagcagcaagctctggcagcgagagggcagcgccagagacgccgatcgtggccgaaacgtggcgagtccaggcgtcggcgccatccgcacgggaaaagaccgtcacaccccggcgcccggattcgtcagcctcgccgaccgacacggacaggtgcacgctagcggacgacggcagcagcagcggggtttcgatcaccagctcatcgaccacgtcacaccccacctcatcagcggcgcggacgaccagctccacaaacccggtaccgggcagcagcacactgccccgcaccgcgtgatcagccagccaggcatgcgtggccagtgatacccgcccggtcaacagcacaccatcggactcaggcaactccaccgccacacccagcaacggatgaccgcccgcaaccgaccggtccgcaccctcggcccagaagcgctggtgctggaacgcgtacgtcggaaggtccggtacccgtgtcgtggcggtgcccaggattgcgggccagtcgacggtcacgccctcgacaaacgcctgtgccagggcggtgagcatccgggtggcgtccccgtcgtcacgacgcagcgtggcaaccgtgacgacatcgtcgtccatcgcctgcaacaacaccggactcgcgctgacctccacgaacacggtgtcgccctcagcacgcaactggccgacggcggagtcgaagcccaccggttcacgcaggttccggtaccagtactccacatcgagcggaccctcgacccacgtcccatcaacggtcgacagccacggcaccaccggagcctgcgaaccgatacccgcggtgatgtcgagcagctcgtcacggatcagctcgacgtgcggcgtgtgcgaggcgtagtcaacggcgatccgccgcacccgcaccccccgcgcctcatgaaccgccagcacacggtccaccgcctccggcgcacccgcaaccaccgtagacgcgggaccgttgtgggcggcgatccaggccccgtcgaccagctcgatctcgtgcgcgggcagggcgacggatgccatcgcgccccggcccgccaggccgcgggcgatcgcctggctgcgcaaggtcacggatctggcggcatcccgcaacgacaccgcaccggccacacacgccgcggcgatctcaccctgcgaatggccgatcaccgcatcaggccgcacaccgtccgcctgccacaccgcggccagggaaaccatcaccgcccacgaagcaggctgaaccacatcgacccggtccaccaccgccggatcatccagcaccgcgaacagatcccagtccacaaactcactcaacgccgccgcacactcggccatccgctcggcgaacaccaccgacgaaccccgcagcgcactgcccatccccagccactgccacccctgccccggaaaaacgaacaccactcgggggttggacaccgccgtgccggtaccggtgacggtgacggtgtcgtggccgaggagtacggcacggtgctcgaacaccgaacgcgtcagcgccagcgtcgaccccacagcccgcatatccgccccgggcgacgccgccaggtaggcgcgcagccggtcctcgtgttcggtcagcgccgggagcgtcttggctgatatcaccagcggcaccagctccgaggccacaactggtgtcgctacgggctgcgcgttgttcacagactgggcgggtggtgcgctctcaaggacgacatgcgcgttcgtaccactgaccccgaaggccgacacacccgcccggcgcggccgaccggtgacgggccaggactggttttccgtcaccagctcaaccgcacccgccgaccagtccacatgccgcgacggctcgttcacatgcagggtgcgcggcaccgtgctgtgctgcagggccatcaccatcttgatgacacccgacacacctgcggcagcctgcgtatgtccgacgttcgacttcaatgtgcccagcagcagaggctgctcacggtcctgaccgtaggtggcgatcaccgcctgggcctcgatcgggtcacccagcgtcgtacccgtgccgtgtgcctcgaccacatccacctcggcggtggtcagacccgcgttggccagcgcctgccggatcacccgctgctgggcgggtccgttcggcgccgtgaagccgttggacgcgccgtcttggttgactgccgatccgcgaacgactgcgagcacctggtggccgttgcggcgggcgtcggagagccgctcgaccagcagcagacccgcgccttcggagaaaccggcaccatccgcactgtccgcgaacgccttgcaccggccgtcggaggccagaccacgctgccgggcgaactcggtgaagacctccggcgtggccatcaccgtcacaccaccggccaacgccatcgaacactcaccattgcgcaacgcctgcgccgccagatgcaaagcaaccagggacgaggagcacgccgtgtccatcgtgatcgccggaccctcaaggccgaagaagtacgacagccggccggacaacacgttgggagccgcggtcgcaccgtaaccctcgcgggcagcaccggcgccgtaaccaacggggaacgcgccaatgaagacgccggtgtcgctgccgcgtacggaaccgggctcgatcccggcccgctcgaaggcctcccaggacacctccaacagcagcctctgctgcggatccatcgccaacgcctcacgcggactgatcccgaagaatccggcgtcgaagccagccgccgtgtccaggaagccgccctcagcgcggtacgacttcccggccgcgtccggatccggatcgaacaggccctcgacgtcccagccacggtcggtgggaaagccggagaccgcgtccgtacccgactcgaccaagcgccacagatcctccggcgacgacacaccgcccggcagacggcacgccataccgacaatcgccaacggctcgtcctgcgccaccgccggcaccggctcgcgtaccggtgcagggttctcgccggtgaacaactcgtccaaccgagcagccaaggcggtcggggtgggatagtcgaacaccatcgtggcgggcagccgcagccccgtcgccttcaccaggctgttccgcagctccaccgcggtcagcgaatccacgcccaaatccttgaacgcaccggtcacgggaatggtgcgggcgtcggcgtgccccaggaccacggcggcactgtcacacaccaccttcagcagcgccttctcccgctcggccggtgccagggcggccagccactgcaccccaccgtcggcggaagcggcccgccgggcgaccgggcgacgcaacgaacgcagcaacgccggaacctccgcggcccgtgccggatccagcgacgcggccatcagaagcggctcgccacgatgcgatgcgctgtcgaacaggcgcatcccacgctcggcggagatggtccgcagaccgatcaggtcactggtctcttctgacgaaccccaggcgagtgcgagtgcgggcagcccctcggcacgacgttggtcggccagcgcgtccaagaacgcggtggccgccgcgaggttgccctgccccggattacccatgacaccggcggccgaggaatacatgacgaacgcggccaggccggtgttgcgagtgagttcgtgcaggtgccaggcgccgtcggctttgggccgtaggaccgtgtccagccgctgcgcggtcagggtctccaagacgccgtcgtcgagtgcgccggcggtttggatcaccgccgtcagcgggtgttccggtgatacgcccgccagcacccgcgccagcccggcacggtccgacacgtcgcagtccgccgtctcgacccgagcgcccagctcgccgagttcgttgagcaacccctcgtcggcagtggtgcgggacagcagcaggagatgacgtacgccacgttcggtgaccaggtggcgggcgagggcgcctgccaggacgccggagccgcctgtgatcaggaccgtgccatgcgggtcccacaccgtttcagattcgggctcagcggcgttcacccgggccagccgtggcacttcgaaccggccgtcgttgacccgcaggcggggctcgtccagtccgacggtagcggccagttggtggagggtgaggctgtcgtcgtcgctttccaccaggacgaagcggccggggtgttccgactgggctgaacgcatcagccctgacaccgcggcggcggccagcccggtgccggtccgcacgaccagtgtgctgtcggtgaagcgctccccgccaagccacgcctgggccgtctggagcacctgggcggtcagcgtacgagtctgtaccagcggatcagggctgccgtcggcctcgggacgtgcggtgtagaccgccacgtcggggaccggcacgtcaccgtccgccaggtcttcgtacctgccgacgctcaggctgctctgctggggagtcgggatctccgtccataccagcgtgagcaggtcatcggcagcggagccgagtgtgtcggctgtcaccggccgggtgacgagggaaccgatggtggccacgggcctgccggtgtcgtcggcgacccgcacactccagccgtctgttgtcggtgttgccgcgacgcgcagcatggctgtgtcggtcgctcggatttggacgtggttccaggagaacggcatccgcacgctctgctggtcggtatcgggtgtgtgcaggacgctggcgtgcatggcggcgtccaacagcgccggatgcaccgcgaaccgtgccgcctcctgcgcctgctcctcagcgaggacgacctcggcgtagacggtgtccccgtcacgccacgcggcctgcagcccctggaacgcgggaccgtactcggtacctgccgcagccagccggtcgtagaagtcggccacgctcaccggccgggcctgggctggtggccacgaggcaaactccggcagcgagaccgtcgagtcagaggtgctgactgtcgccgtgacgtgccgggtccaggtatcggtgttgtccgcctgggagaagaccatcaccgcgcggtgcccggactcgtcggctccgccgacggacacggacagttggacgcctccggtctgcggcagcaggagcggggtttcgatcaccaactcgtcaacgacgtcggactcgacctcgtcggcggcgcggacgaccaggtccacaaatgcggtcccgggtagcaggacactgccccggaccgcgtgatcggccagccatgtatgggtggccagcgacacccgcccggtgagcaccacaccgtcggaggccggcaggtccactacggtgcccagcagtggatgaccgtcggcagccgcccggtccacgctcctgagccagtaccgctggtgctggaaggcgtaggtcggaaggtccagtacccgggttgtggcggtgccgaggatggcgggccagtcgacggtgacgccgtggacataggcctgtgccagggcggtgagcatccgggtggcgtcgccgtcgtcacgacgcagcgtggcaaccgtgacgacatcgtcgtccatcgcctgcaacaacaccgggctggcgctgacctccacgaacacggtgtcaccctcggcctgcaactggccgacggcggggtggaaaccgaccggctcacgcaggttccggtaccagtactccacatcgagcgggctgtcgacccaggagccgtccacggtcgacagccacggcacgaccggggcctgcgagctgctgtcgctagtgatgtcgagcagttcgtcgcggatcagctcgacgtgcggggtgtgcgaggcgtagtcgacggtgatccgccgcacccgcacccctcgcgcttcatgagcggtgaggacatggtcgaccgcttccggggtgcccgcgatcacggtggaggcgggaccgttgtgggcggcgatccaggccccgtcgaccagctcgacatcctgtgcgggcagggcgacggatgccatcgcgccccggcccgccaggccccgggcgatcgcctcgctgcgcaaggtcacgatccgggcggcatcccgcatcgacaccgcacccgccacacacgccgcggcgatctcaccctgtgaatggccgatcaccgcatccggccgcacaccggccgcctgccacaccgcggccagggagaccatcatccgccaggaagcgggctggaccacatcaacccggtccaccaccgccggatcatccagaaccgtgaacaggtcccagtccacgaactcgcgcaacgcgggcgcgcactcggccatccgctcggcgaacacgatcgaggaatcgcgcagcgcactgcccatccccagccactgccacccctgccccgggaaaacaaacaccacccggggatcggacacagcggtgccggtgacggtgtcgtctccaaggagtacggcgcggtgctcgaacaccgaccgtgtcaccgcgagcgttgatgcaacagcccgtgtatccactccgggcgacgccgccaggtaggcgcgcagccggtcttcgtgttcggtcagggcgggctgggtcttggccgatatcaccagcggcagcacatccgaggccaccaccggcgtctcaacaggctgcgcctcctccgcgggctgagcggggggtgcgctctccaggatgacgtgggcgttggtgccgctgactccgaaggacgacacgcccgcccgacggggccggtcggtgccgggccagggctggttctccctcaccagctcaaccgcacccgccgcccagtccacgtgccgcgacggctcatccacgtgcagggtgcggggaaccgtgttgtgctgcagggccatgaccatcttgatgacacccgacacgcccgaggcggcctgagcatgaccgatgttcgacttcagcgagcccagcagcaggggccgttcccggtcctgaccgtaagtggcgatcaccgcctgggcctcgatcgggtcgcccagcgtcgtacccgtgccgtgggcctcgaccacatccacctcggccgtggtcagacccgcgttggccagcgcctgccgaatcaccccctgctgggaggggccgttcggcgcggacaggccgttcgacgcgccgtcctggttgaccgccgagctacggaccaccgccaacacctgatggcccttggcctgggcgtcggaaagccgctctaccagcagcacaccaacgccttcagcccatcccgtgccatccgcgctgtctgcgaacgccttgcaccggccatcggagtcaagaccactcttccgcgagaactccacgaaactttgcggcgtggccatcaccgtgacaccaccgaccagggccagggaacactccccctgccgcagggcataccccgcctggtacaatgccaccagcgacgacgaacacgccgtgtccaccgtgatggcggggccttcgaggccgaagaagtacgacacccggccggacaggacactggtcgcgctggcggtggccgcgaagccgccgaggtcagcaccggcaccgtagccaccggcgtacgcgcccatgaagacgccggtgtcgctgccgcgcacggaaccgggctcgatcccggcccgctcgaaggcctcccaggacacctccatgatcagccgctgctgcgggtccatcgccagagcctcgcgtgggctgatgccgaagaatccggcgtcgaagctggctgcgctgtcgaggaagccgccctctacgcagtacgacttcccgaccgcgtccgggtccggatcgaacaggctctccgcgtcccacccacggtcggcggggaaaccggaaatcgcatccgtacccgactccacaaggcgccacagatcctcaggcgacgacacgccgccgggcagacggcaggccatacccacgatcgccagcggctcgtcctgccccaccaccgaggcggtgcgcaccaatacaggattctcgccggtgaacaactcccccagccgagcagccaagaccgccggggtcggatagtcgaacaccaacgtggccggcaaccgcaaccccgtcaccttcgccagaccgttccgtagttccaccgcggtcagcgaatcaatgcccagatccctgaacgctccggtcaccggaatggtgcgggcatcggcgtgccccagaaccgtcgcggcggtgtcacgcaccaccttcagcagtgccttcgcccgctcctccggcgccagggctgccagccactgcgctccaccggcgagagcggcacgccggacgttcggacgatgcaacgaccgcagcaatgccgggacttccgcgtcccgtaccggctccatcggcgcggccaccagaaccggttcactgtggcgtgacgcgttgtcgaacagccgcatcccgtgctcggcggagatggcccgcaggccaccgcgccggatccggtcacggtccgtgtcggtcagttgcgcggtcaggccgctggcgtcctcccagaggccccaggccaccgcgagtgcgggcaggccctcggctcggcgttcttcggcgagcgcgtccaggaacgcgtttgccgccgcgtagttaccctgacccgcaccggccatgacaccggcagccgaggaatacatgacgaacgccgccaggtcggcgtcccgggtgagctcgtgcaaatgccaagcaccatcggccttgggccggaatacggtctccagccgctgcgcgctcagggactccacgacaccgtcatccaccacgcccgcggtatgaatcaccgccgtcaacgggtgctccggcgacacacgcgccaacactcgcgccagctctgcacgatccgacacgtcacaggccgctgtgtccaccgcggcacccaactcggccaactcgctgagcagcgcccggtccggagtgccgcgagacagcagcaggagatgacgcacaccacgttcggccaccaggtgccgggcgacgatccccgccagaacgccggaaccgcccgtgatcaggaccgtgccatccggatcccacgccctttcaggctcaggctcatcggcatgtgcgcgggtcagccgtggtacttcgtaccggccgtcgctgatccgcagccgcggctcgtccaatccgacagtcgcggccagctggtccggagtgagggcgtcgtcatcactttccaccaggatgaaccggccggggtgttcggactgggccgagcgcatcaaccccgacaccgctgccgcggccaaaccagtaccggtccgcaccaccagcgtgctgtcgctgaagcgttccccgccaatccactcctggactgtccgcagaacctgcgcggtcagtatgcgagtctgtgccagcgggtcgtcgttgccggggagcgcggtgaacaccacgacatcgggcaccggcgcatcgccgtccgccgccaggtcttcaaacgcacccaccgtcagaccggtctgctgctggcgggtggcgattcctgcccaggtcagggtgagcaggtcggtggcactggtggccggttcgttgacgggaacggcgtccagcgcgagggagcgggcggtcaggacaggaagccctgtgctgtcgacggcctctaccgacagggtctcgtcatcctgtgaggtgaggcggacgcgcagctcggcagcgttgcgggcgtgcagggtcaagccctgccacgcggcgggagtctcctcgcctacggcggcgaaggcggcagtcatcaggccgggatgaagcaaaaacctggtggcgtcgtgggtgtcgtccagggcgacctcggcgaacacttcgctgccacggcgccacaccccgcgcagtgacggtactcgggcctcgaccgggaccgcaccggccggcggccacgcctcgccggcctgccagccggacaccctgccggtggtggtggccagggtcgcggtggccaggcgtgtccagagctcgtcgtcgctgtaacgggcgtggatactgagctggcggcggccggcatcgtcgggttcgctcacccaggtctgtacctggacggcgccatcgtcaggaagcagcagcaaggcttccacggtgagttcctcgaccaggccgcagccggtctcgtccgccgctgccagcgccatctcggcgaacgccgtcgcgggcaagaccgtctggtcctgcaaccacagatcaccgctccgggaaacttgcgaggtaaacagcactccactggcctcggccagccctaccgccggcccgagcagcggatgaccgcccgcggccgcccggtccgcaccctcaagccaataccgctggtgctggaaggcgtatgtcggaaggtccagcacccgtgttgccggagcatcgcccagaagcgcggtccagtcgacggtgacgccgttgacatacaggtgggccagggcactgatcgcggcctgtgcctcgtggtcggtgtgcagcatcgcgacaccgtcgaccaggcgggccagcgaccggtcggcacccagctcgatgaacaccgcgtcctcgtacgaggccacctgctcgccgaaccggaccgtgtcccggacctgccgcacccagtactcagccgtcgtcacccgatcaccagcggccatggcgaggcggggtgtttggtaggtgaggcgttcggcgaccgtccggaactcctccagcatgggttccatgcgggcggagtggaaggcatggctggttgccagacgtgttgacttgcccaaggctgctgcggcctgcagtactgcggtttcatcgccggagagaaccaccgacgacgggccgttgaccgcggcgatctccacaccctcacccagcacggcccgggcctcatcttcggagaccgggacggcgaccatcaccccacccgggggcagggcctgcatgaggcgggcccgcgccgacaccagcgtgcaggcatcctccagcgaccacaacccggagacgtatccggcggcgagctcaccgacagagtgaccgaccaccgcgtccggccgtacaccccacgattccagcaacccgaacagggccacctgcaaagcgaacagggccggctgggcatagccggtctcgttcacctccagatcgggcacgtccagcaggccccacacctgctgatggatccgcgcgaagacggggaacgcggcggccagttcctcacccataccagcacgctgcgacccctgacccgggaagacgaacaccacccgcggatcagacaccgtggtcccggtaacggtgtcatctccaaggagcaccgcccggtgctcgaacaccgaacgcgtcaccgccagcgttgacgccacaccccgcacgtccaccccaggcgacgccgccaaatacgcacgcagccggtcctcgtactcgaccagagctggcaacgtcctcgccgaaatcaccagcggcaccaactccgacgccaccaccggcgcctccgcaggcggcacatcgtccacagcctgcgtggggggtgcgctttccaggatgacgtgggcgttggtgccactgatcccgaaggacgacacacctgcccggcgaggccgacccatatccggccacggctggttctccgtcaccagcgcaaccgcgccatccgtccagtccacatgccgcgacggctcatccacatgcaacgtacgcggcaccaagacgtgctgcagcgccatcaccatcttgatgacaccagacacacccgcagcggcctgcgtatgacccagattcgacttcaccgaacccaacagcaacggctgctcacgatcctggccataggtcgccagcagcgcctgggcctcgatcgggtcacccagcgtcgtacccgtgccgtgcgcctcgaccacatccacctcagccgtactcagacccgcattgctgagagccgcccggatcacccgctgctgcgaaggaccgttcggcgcggacaggccgttcgacgcaccgtcctgattgaccgccgatccccgcaccaccgcaagcacctggtggcccttgcgctgggcatcggacagccgctctaccagcagcacaccggcgccttcagcccagcccgtgccgtccgcactatccgcgaacgccttgcaccggccgtcggaggccaggccacgctgccgcgagaactccacgaaactttgcggcgtggccatcacagtgacaccaccgaccagggccagcgaacactcaccctgccgcagggcatacgccgcctgatgcaacgccaccaacgacgacgaacacgccgtgtccaccgtgacagccggcccctcgagaccgaagaaatacgacacccgacccgacaggacactcaccgcaccggcagttgccccgaagccgccgaggtcggcaccaacgccgtagccaccggggtacgcacccatgaaaacaccggtgtcgctaccgcggagggaaccgggttcgatcccggcccgttcgaacgcttcccaggacgcctccaggaccagccgctgctgcggatccatcgccaacgcctcacgaggactgatcccgaagaacgaggcgtcgaaaccgcctgcggagtccaggaagccgccctgcacgcagtacgacttgcctgccgcctccggatcagggtcgtacaggttctcgacgtcccagccacggtcggcggggaatccggaaatcgcgtccgtacccgactcgacaaggcgccacagatcctccggggacgacaccccacccggcagacggcacgccatacccacaatcgccaacggctcgtccatggctgcccgcaacgacgtgttcgccttgcggagccgcgcgttctccttgaccgacttgcgcaatgcgtcgagaagctgatcttccctca

SEQ ID NO: 156 - DNA, 44 bp, Artificial Sequence
  Primer
catgcgcacccgtggacatgtttccccgaaaagtgccacctggg

SEQ ID NO: 157 - DNA, 52 bp, Artificial Sequence
  Primer
ataacgcaggaaagaacatgtgatgcggtattttctccttacgcatctgtgc

SEQ ID NO: 158 - DNA, 32441 bp, Artificial Sequence
  Plasmid
tatgtgtcctccttaattaatcgatgcgttcgtccggtggtcgtcgtcatcgtcggccccgtggctcgaaggaggctcgaaggccgatacgggacccctcgatgccggatccaccggcgccgcgtccagcggcaccccatctcccttcgaccgccgctcgagccgggcgcccaaagctgagcgcgtgagggaccacgaggcagggaggggaacacttaagaggggctccaccgcgttcacggaccggtgctacacgagcaccttctcaccgttgagaatttccatgtgcatacgctggatttccggcgtcggatccacccccagttcgtcggacagtatccgccggagattccgatacgattccagcgcctcggcgcgcctgcccatctgacagagcgcgcccatcagtttggcgtgcagggtctcgttcagcggatgcgaaattaccagggaccggagttccggaatcatcggccctattctgcccagccgccaattcgcgtcgatacggagctgcattccaaaaagccgcagctcttccaggtgcgcgatattgctttcgagcacccggccgcacggtacggtggacagcgccgggcctcgccagagatccagtcccgcgtccaacgaggcgagcgcctcctcgagccggttctcctcgagcagccggccgccggtgcggatcagacgctcggcgaccgcgacgtcgagttcgtcctcgtcgatcagggcgaagtagccgggcggctgggtcaggaccaattcccggtcgtcgctcgtcacccggtgctcccccagcagccggcgggtgtggtacacgtacgtctgcagcgtcgtcatggcgctgcggggcgggtggtccgcccacaactcctcgatgagcacccccgatcccaccacctcgtgccgcctgaggagcagcagcaccaggagctgggtcgccttcgaggatttaagcggaattacacatcccgcatcggtgattacatggacacgtcccaataagttgaatctcatctgcgcccccgtcgagattctccgtctcctgggggcgacaataacaggcctactcaacagatttcaatgtgcttgccgtcacaagcgatctcctattgatcaaaaattaatcagtgcagcgagctgcactgattaatttttgctggattttaccgagaggcagtggactagtttactggcgtaatagcgaagaggcccgcaccgatcgcccttcccaacagttgcgcagcctgaatggcgaatggcgcctgatgcggtattttctccttacgcatctgtgcggtatttcacaccgcataaattccccaatgtcaagcacttccggaatcgggagcgcggccgatgcaaagtgccgatcaacataacgatctttgtagaaaccatcggcgcaggtatttacccgcaggacatatccacgccctcctacatcgaagctgaaagcacgagattcttcgccctgcgagagctgcatcaggtcggagacgctggccaacttttcgatcagaaacttctcgacagacgtagatcaggcttcccgggtgtctcgctacgccgctacgtcttccgtgccgtcctgggcgtcgtcttcgtcgtcgtcggtcggcggcttcgcccacgtgatcgaagcgcgcttctcgatgggcgttccctgccccctgcccgtagtcgacttcgtgacaacgatcttgtctacgaagagcccgacgaacacgcgcttgtcgtctactgacgcgcgcccccaccacgacttagggccggtcgggtcagcgtcggcgtcttcggggaaccattggtcaaggggaagcttcggggcttcggcggcttcaagttcggcaagccgctcttccgccccttgctgccggagcgtcagcgctgcctgttgcttccggaagtgcttcctgccaacgggtccgtcgtacgcgcctgccgcgcggtcttcgtacagctcttcaagggcgttcagggcgtcggcgcgctccgcaacaaggttcgcccgttcgccgctcttctcaggcgcctcagtgagcttgccgaagcgtcgggcggcttcccacagaagcgccaacgtctcttcgtcgccttcggcgtgcctgatcttgttgaagatgcgttccgcaacgaacttgtcgagtgccgccatgctgacgttgcacgtgccttcgtgctgcccaggtgcggacgggtcgaccaccttccggcgacggcagcggtaagagtccttgatcgattcttccccgcgcttcgaagtcatgacggcgccacactcgcagtacagcttgtccatggcggacagaatggcttgcccccgggaaagccccttgccgcgccccctgccgtccaaccacgcctgaagctcataccactcagcgggctcgatgatcggtccgcaatcaagctcgaccggccggagcgtgatcgggtcgcgctgaatgcggtaaccctcaatcttcgtggtcggcgtgccgtccggcttcttcttgtagatcacctcagcggcgaagcccgcaatacgcgggtcccgaaggattcgcataacggttgccgggtcccaggcgcttgaagcggtcttcttcccaatcgtctcgccccgggtcggcacggcgtcagcgtccatgcgcttacaaagccccgtgatgctgcccgggtgaatggcggcttgactgcccggcttgaagggaaggtgtttgtgcgtcttgatctcacgccaccaccaccggattacgtcgggctcgaactcgaagggtccggtaaggggagtggtcgagtgcgcaagcttgttgatgacgacattgaccattcggccgttgcgcgtgatctccttcgtctccgaaacaagctcgaagccgtaaggcgccttcccgccgacgtacccgcccaattcgcgctgaaggttcttcgtgtcgagaatcttcgccgacttcagcgaagattctttgtgcgacgcgtcgagccgcataatcaggtgaatcaggtccatgacgtttccctgccggaagacgccttcctgagtggaaacaatcgtcacgcccagggcgagcaattccgagacaatcggaatcgcgtccatgaccttcaggcgcgagaagcgcgacacgtcatagacaatgatcatgttgagccgcccggcgcggcattcgttcaggatgcgttcgaactccgggcgctccgccgtcccgaacgccgacgtgcccggcgcttcgctgaaatgcccgacgaacctgaaccggcccccgtcgcgctcgacttcgcgctgaaggtcggccgccttgtcttcgttggcgctacgctgtgtcgctgggcttgctgcgctcgaatttcgcgctcgcgcgactgacggtcgtaagcacccgcgtacgtgtccaccccggtcacaaccccttgtgtcatgtcggcgaccctacgcccccaactgagagaactcaaaggttaccccagttggggcactactcccgaaaaccgcttctgacctgggaaaacgtgaagccccggggcatccgctgagggttgccgccggggcttcggtgtgtccgtcagtacgggccatagaggggcgtcgtgtaacccacccagggcgattgctccggcacggggaagccgcgccacgccttcgggacgtcatggcaatcgctagagcttgcatgcctgcaggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctggcggcctgctgaaactctggctcaccgacgacccgcgcacggcgtggttcggtgatgccacgatcctcgccctgctggctgaagatcgaagagaagcaggacgagcttggcaaggtcatgatgggcgtggtccggccgagggcagagccatgacttttttagccgctaaaacggccggggggtgcgcgtgattgccaagcacgtccccatgcgctccatcaagaagagcgacttcgcgaagctggtgaagtacatcaccgacgagcaaggcaagaccgatccccggggacctgcaggtcgactctagctagctggccagggcccgatacgtcgcggtgagttcaggctttttcatatctcattgcccccggacgagcgtctgctccgccattcgccgtccgccgtgccaatcggatcagccgtccaaatgcgggattttcgttagtcggaggccaaacggcattgagcgtcagcatatcatcagcgagctgaagaaagacaatccccgatccgctccacgtgttgccccagcaatcagcgcgaccttgcccctccaacgtcatctcgttctccgctcatgagctcagccaatcgactggcgagcggcatcgcattcttcgcatcccgcctctggcggatgcaggaagatcaacggatctcggcccagttgacccagggctgtcgccacaatgtcgcgggagcggatcaaccgagcaaaggcatgaccgactggaccttccttctgaaggctcttctccttgagccacctgtccgccaaggcaaagcgctcacagcagtggtcattctcgagataatcgacgcgtaccaacttgccatcctgaagaatggtgcagtgtctcggcaccccatagggaacctttgccatcaactcggcaagatgcagcgtcgtgttggcatcgtgtcccacgccgaggagaagtacctgcccatcgagttcatggacacgggcgaccgggcttgcaggcgagtgaggtggcaggggcaatggatcagagatgatctgctctgcctgtggccccgctgccgcaaaggcaaatggatgggcgctgcgctttacatttggcaggcgccagaatgtgtcagagacaactccaaggtccggtgtaacgggcgacgtggcaggatcgaacggctcgtcgtccagacctgaccacgagggcatgacgagcgtccctcccggacccagcgcagcacgcagggcctcgatcagtccaagtggcccatcttcgaggggccggacgctacggaaggagctgtggaccagcagcacaccgccgggggtaaccccaaggttgagaagctgaccgatgagctcggcttttcgccattcgtattgcacgacattgcactccaccgctgatgacatcagtcgatcatagcacgatcaccggcgctgttgcaaatagtcggtggtgataaacttatcatccccttttgctgatggagctgcacatgaaccaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagatttctagcttggattctcaccaataaaaaacgcccggcggcaaccgagcgttctgaacaaatccagatggagttctgaggtcattactggatctatcaacaggagtccaagctcagctaattaagcttagtgatggtgatggtgatgagatctggtctagattcatcgttcttcctccagcacgtgcttgatgagagcgtcagcgtccatctcatcgacgaaggcctcgtcatcggattccgaatcgggctttggaacggccaggccctccatggctgccagcctcagcagcgtgtccagcacaccggcctcccggaacttgtcaatcgagatccccgcgagcgctcggcgtagctcctgctcgtggaggcgaggttccggctccgccggagcgaacaactcgtccagccgggcggccagggccgtcggggtggggtagtcgaacaccaacgtgggcggcagccgcaggcccgtcgccttcgccagactgttccgcaggtccactgcggtcagcgaatccacacccagatccttgaacgccgcggtcacgggaatgctgtcgatgtcggcgtgtcccagaaccgtcgcggcgctgtcacacaccaccctcaacaacgccttcgcccgttcctccggtgccaaagctgccaaccactgcactgacgagtcaccggtagaggcggccctgcgagcaatcggccggtgcaacgaccggagcagcgccgggacttccgcgtcccgtaccggctccatcgccgcgcccaccagaaccggttcactatggcgtgacgcgctgtcgaacagccccatcccgtactcggcggagatggcccgcaggccaccgcgccggatccggtcacggtccgtgtcggtcaggtccgcggtcaggccactggcgtcctcccacagaccccaggccaccgcgagtgcgggcagaccctcggcacgacgctgctcagccagcgcgtccacgaacgcattggccgccgcgtagttggcctgccccgcactaccgagcacaccggcggcggaggaatacatgacgaacgccgccaggtcggcatcccgggtgagctcgtgcaggttccacgcgccatcggccttgggccgcaacaccgcgtccagccgctgcgcggtcaaagattcgaccacaccgtcatcgagtgcgcccgcggtgtgaatcacggccgtcagggggtgctccggtgacacacccgccagcacctgggccagcgcggcacgatcggacacgtcacaggccgctgtctcgacccgggctcccagttcgccgagttggttgatcagtgcctcgtccggggcgctgcgggacagcagaaggagatgacgcacgccgcgttcggccaccaggtgccgggcggcgatccccgccagcacacccgaaccaccggtgatcaggaccgtgccatccggatcccacaccttctctgactcgggttcagcggcatgcgtacgggtcagtcgtggcgcttcgaagcggccgtcgctgatccgcagccgcggctcatccagtccgaccgccgccgccagctgatccggagcgagggcgtcgtcatcactctcgaccaggacgaaccggccggggtgttcggactgggccgaccgcatccaacccgacaccgcagcagcggccaaaccagtaccggtccgcaccaccagcgtgctgtcgctgaagcgctccccgccaagccactcctgaactgcctggaggacctgaccggtcagctttcgtgtttgctccagcgggtcgtcgtcgttgtcggggagtgcggtgaagaccgccacctcgggcaccggcacatcaccgtccgacaccagctcctcgaaccggccgaccgtcaggccggtctgctggggggtggggattcctgcccaggtcaaggcgagcaggtcatcggcagcggaaccgagcgcgtcggccgtcaccgggcgcgtcacgagcgaacccacgctagccaccggccgaccgatgtcatcagcgacccgcacactccagccatccgccgcctgcgtcaccgcgacacgcaacatggccgaaccaccagcatggacccgaacaccgttccaggagaacggcagccccacacccacctcggcatcggacgcattcaaggtgcaggcatgcagagccgcatccagtagagccggatgcacggcatatcgcgccgcctcccgcacctgctcctcagccagagccacctcggcgaagacagtgtccccatcacgccacgcggcctgcaaaccctggaaggcaggtccgtactcgtaacccatcccggtcagctggtcgtagaagcccgccacgtccaccggcttggcctgcgcaggtggccacgcggtgaggtccgacggtgggacagtcgtgtcggaaaccctgacggtggcggaaacgtgccgggtccaggtatcggcgttgtccgcccgggagaagaccgtcaccacccggtgtccggactcgtcggcctcgccgacggacacggacaattgcacaccgccggtctgcggcagcaggagcggggtttcgatcaccagctcatcgacaacgtcacaaccgacctcgccagcggcgtggacaaccagctccacaaatgcggtaccgggcagcaggactctgccccagaccgcgtgatcagccagccacgcgtgggtggccagcgatacccgcccggtcaacagcacaccatcggattcaggcaactccaccaccgcacccagcaacggatgaccatccgcagccgcccggtccacgctcttgacccagtaccgctggtgttggaaggcgtaggtcggaaggtccagcacccgggccgtggtggtgccgaggatggcgggccagtcgacggtgacgccgtggacataggcctgtgccagggcggtgagcatccgggtggcgtccccgtcgtcacgacgcagcgtggcaaccgtgacgacatcgtcgtccatcgcctgcaacaacaccggactcgcgctgacctccacgaacacggcgtcgccctgagcctgcaactgactgacggcggggtggaaaccaaccggctcacgcaggttccggtaccagtactccccgtccagcgggctgtcgacccaggagccgtccaccgtcgacagccacggcaccaccggaggctgcgaaccgataccggcggtgatgccgagtagttcgtcgcggatcagctcgacgtggggggtgtgcgaggcatagtcgacggtgatccgccgcacccgcacccctcgtgcttcatgagcggtgaggacatggtcgactgcttccggggtgcccgcgatcacggtggaggcgggaccgttgtgggcggcgatccaggccccgtcgaccagctcgatctcgtgcgcgggcagggcgacggatgccatcgcggcccggcccgccaggccccgggcgatcgcctggctgcgcaaggtcacgatccgggcggcatcgcgtagtgacaccgcaccggccacacaggccgcggcgatctcaccctgcgaatgaccgatcaccgcatccggccgcacaccggccgcctgccacaccgcggccagcgaaaccatcaccgcccacgaagcaggctgaaccacatcaacccggtccaccaccgccggatcatccagcacggcgaacagatcccagtccacaaactcactcaacgccgccgcacactcggccatccgctcggcgaacaccaccgaggaatcccgcagtgcactgcccatccccagccactgccacccctgccccgggaaaacaaacaccacccgggggtcggtcaccgcggtgccggtgacggcgtcatctccaaggagtacggcgcggtgctcgaacaccgaccgcgtcaccgccagcgtcgatgccacagcccgcgtatccgccccgggcgacgccgccaggtaggcgcgcagccggtcttcgtgttcggtcagggcgggctgggtcttggccgatatcaccagcggcagcacatccgaggccaccaccggcgtctcaacaggctgctcctcttccgcgggctgtgcggggggtgcgctctccaggacgacgtgggcgttggtgccgctgactccgaaggatgacacgcctgcccggcggggccggtcggtgccgggccagggctggttctccctcaccagctcaaccgcacccgccgcccagtccacatgccgcgacggctcatccacatgcaacgtgcgcggcacgaaaccgtgccgcagcgccatcaccatcttgataacacccgacacacccgaggcagcctgcgtatgaccgatgttcgacttcaacgagcccagcagcaacggctgctcacggtcctggccataggtcgccagcagcgcctgggcctcgatcgggtcacccagcgtcgtacccgtgccgtgcgcctcgaccacatccacgtcagccgtactcagacccgcattgctgagagcggcccgaatcacccgctgctgcgaaggaccattcggcgcggtcagaccgttcgacgcaccgtcctggttcaccgccgatccacgcaccaccgccaacacctggtgaccgttacggcgggcgtcggacagccgctcgaccagcagcagacccgcgccttcggagaaaccggcaccgtccgcactgtccgcgaacgccttgcaccggccatcggaggccagaccacgctgccgggcgaactcggtgaagacctccggcgtggccatcaccgtcacaccaccggccaacgccatcgaacactcaccattgcgcaacgcctgcgccgccagatgcaaagcaaccagggacgaggagcacgccgtgtccatcgtgatcgccgggccctcaaggccgaagacgtacgacacccggccggacaacacgctggggccggacgtggcgccataaccttcgcgatcgaacccggcgccgtagccaacggggaatgcccctatgaaaacgccggtgtcgctgccgcgtacggaaccgggctcgatcccggcccgctcgaacgcctcccaggacacctccaacagcagccgctgctgcggatccatcgccaacgcctcacgcggactgatcccgaagaatccggcgtcgaagccagccgccgtgtccaggaagccaccctgcacgcaatacgacttccccgccgcctccggatcagagtcgtacaggttctccacgtcccagccacggtcagtgggaaatccggagaccgcatccgtacccgactcgaccaaacgccacagatcctccggcgacgacaccccacccggcaaacggcacgccatacccacaatcgccaacggctcgtcctgccccaccaccgacaccggcccgcgtaccggtgcagggttctcgccggtgaacaactcgtccaaccgagcagccaagaccgtcggggtcggatagtcgaacaccaacgtggccggcaaccgcaaccccgtcgccttcaccagaccgttccgtagttccaccgccatcagcgaatccacacccagatccttgaacgcgccagccgccggaatgctgcgtgcgtcggcgtgccccagaaccatggcggcactgtcacacaccagcttcagcagcgccttctcccgctcggccggtgccagggcggccagccactgcaccccaccgtcggcggaagcggcccgccgggcaatcgggcgacgcaacgaacgcagcaacgcagggacttcgccgtctcgggtcgggtccaacaccgcgggcaccaagagcggttcgccatggtgcgacgcggtgtcgaacagccgcattccgtcctcagcggtgatggttcgcatgccgctgcaccggatccggtcctggtcggtgccggtcagttgcgcggtcaggtccccggtgtactcccacggaccccacgccagcgcgagtgcgggcaggccctgggtacgccgttgttcggccagggcgtccaggaacgcgttcgccgccgcgtagttgccttgcccctcattacccagcacagcggcagccgacgagtacacgacgaatgccgccaggtcggcatcccgggtgagctcgtgtaggtgccaggcgccgtcggccttgggccgtagcaccgtgtcgagctgttgtgtggtgagggattccacgacgccgtcgtcgagtgcgccggcggtgtggatcaccgccgtcagcgggtgttccggtgatacgcccgccagcacccgtgccagcccggcacggtccgacacgtcgcaggccgctgtctcgacccgggcgcccagctcggcaagctccttgatcagtgcttcgtcgggagcggtgcgggacagcagcaggaggtgacgtgcaccgtgttcggctgccaggtggcgggcgaggatgcctgccagaacgccggaaccgccggtgatcaggatggtgccgtcggggtccggccggcgggggatggtgaggacgatcttgccgatgtgccgcgcgcggctcatccagctgaacgcatcgcgagcttggcgaatgtcccaagtttgtacgggcagcggctgtaggacgccttgtccgaacaggctgaggatttcggtaatgatctcccgcagccggtccgggccgacgtccatcaggtcgcacgcctggtacgtggtgccgggccggtcggcggtgatccggtgcgggtcgcggatgtcggtcttgccgatttccacgaaccggccgccgcggggcagcaggtcgagggaggcgtcgacgaagtcaccgctgagggagttcaggacgacatcgacaccccggccgtcggtagtgttcaggaacgcttcccggaagcccgtggtgcgggaatccgcgatccgagtgccgtccagacccgcctcgtacagaatgtgctgcttgcccgcgctggcggtcgcgtagatctgcgcgccgaggtggcgagcgatctgggtcgctgccatgcccacaccacccgcggcggcgtggatcagcacggactcacccgcactcagcccgcccagatccaccagcccgtaatacgcggtggcgaacacaaccggcacggacgccgccgtagtgaacgaccagccatcaggaatcacggcgagcattcgacggtcggcgatcgcgaccgccccgaatccgccgcccacaagaccgaacactcggtctcccggggccaggtcgtgggcctccgggccgacctcgagcaccacgcccgcagcttcagccccgatcacagcctcaccgggataagtgccgagcgcgataagaacgtcgcggaagttcaggcctgcggcgcgtacgtctatgcgtacttcgccgggtcgcaggggccgttcggcggtgtcggtgggtaccagagcgaggtcttgcagggttccgctgcggggttgttccagcagccaggcacgatcgtcggggatcgtcagcgggctgctctccggcgtattcgcccgcgccagccgcggtacctcgaaccggccgtcgcagacccgcagccgcggctcgtccagcccggcggtcgccgccagctggtccggggtgagggtgtcgtcgtcgccttccaccagaacgaaccggcccgggtgctccgactggaccgaacgcatcagccctgacaccgcggcggcggccaacccggtgccggtccgcacgaccagcgtgctgtcggtgaaacgttccccggccagccatgcctggactgcctggagaacctgggcggtcaacgtgcgagtctgtgccagcggatcagggctgccgtcggtgtcgggacgcgcggtgtagaccaccacctcgggcaccggcacatcggcgtccacgagatcctcgaaccggccagtggtcagaccggtctgctggggaatggggatctccgtccagaccaccctgagcaggtcatcggctgcggagccgagcgcgtcggctgtcaccgggcgcgtcacgaatgagccgatggtggccaccggccgaccgtcgtcatcggcgacgtgcacactccagccgtctgttgtcggtgtcatcgcgacgcgcagcgtggccgagccagtggcatggacttggacgtggctccaggagaacggcatccgcaggctctgctgctcagcgtcgggtgtgtgcaagacgctggcgtgcagggcggcgtccaacagcgccggatgcaccgcgaaccgtgccgcctcctgcgcctgctcctcggccagagcgacctcggcgtaggcggtgtccccgtcacgccacgcggcctgcagcccctggaacgcgggaccgtactcggtacctgcggcagccagccggtcgtagaggtcgcccacgttcgtcggctgggcctgggctggcggccacgaggcaaactccggcagcgagaggggtgcatcagaggcgctgatcgtggcggaaacgtgccgggtccatgtgtccgcgttgtccgcccgggagaagaccgtcaccgcgcggtgtccggactcatcggcctccgcgacggacacggacagttggacgcctccggtctgcggcagcaggagcggggtttcgatcaccagctcatcgataacgtcgcactcgacctcgtcggcggctcggacgaccagttccacaaatgcggtcccggggagcaggacactgccccggaccgcgtgatcggccagccatgtatgggtggccagcgacacccgcccggtcagcaccacaccattggagtccggcaactccacggccacacccagcaacggatgaccacccgcagccgagcgatccacaccctcgacccagtaccgctggtgttggaaggcgtaggtcggaaggtccagtacccgggttgtggtggtgccgaggatggcgggccagtcgacggtgacgccgtggacataggcctgtgccagggcggtgagcatccgggtggcgtcgccgtcgtcacgacgcagcgtggcaaccgtgacgacatcgtcgtccatcgcctgcaacagcaccgggctggcgctgacctcgacgaacacggtgtcgccctgggcctgcaactggccgacggcggggtggaaaccgaccggctcacggaggttccggtaccagtactccccgtccagcgggctgtcgacccaggagccgtccacggtcgacagccacggcacgagcggggcctgcgagctgctgtcgctagtgatgtcgagcagttcgtcgcggatcagctcgacatgaggggtgtgcgaggcatagtcgacggtgatccgccgcacccgcacccctcgcgcttcatgagcggtgaggacatggtcgaccgcttccggggtgcccgcgatcacggtggaggcgggaccgttgtgggcggcgatccaggccccgtcgaccagctccacatcctgcgcgggcagggcgacggatgccatcgcgccccggcccgccaggccccgggcgatcgcctggctgcgcaaggtcacgatccgggcggcatcccgcaacgacaccgcacccgccacacacgccgcggcgatctcaccctgcgaatgcccgatcaccgcatccggccgcacaccggccgcctgccacaccgcggccagggaaaccatcaccgcccacgaagcgggctggaccacatcaacccggtccaccaccgccggatcatccagaaccgtaaggtcccagtccacaaactcactcaacgccgccgcacactcggccatccgctcggcgaacaccaccgacgaatcccgcagggcactgcccatccccagccactgccacccctgccccgggaaaacaaacaccacccggggatcggacacagcggtgccggtgacggtgtcgtctccaaggagtacggcgcggtgctcgaacaccgaccgcgtcaccgccagcgtcgatgccacagcccgcgtatccgccccgggcgacgccgccaggtaggcgcgcagccggtcttcgtgttcggtcagggcgggctgggtcttggccgatatcaccagcggcagcacatccgaggccaccaccggcgtctcaacaggctgcgcctcctccgcgggctgagcggggggtgcgctctccaggatgacgtgggcgttggtgccgctgactccgaaggacgacacgcccgcccgacggggccggtcggtgccgggccagggctggttctccctcaccagctcaaccgcacccgccgcccagtccacgtgccgcgacggctcatccacgtgcagggtgcggggaaccgtgttgtgctgcagggccatgaccatcttgatgacaaccgacacgcccgaggcggcctgagcatgaccgatgttcgacttcagcgagcccagcagcaggggccgttcccggtcctgaccgtaagtggcgatcaccgcctgggcctcgatcgggtcgcccagcgtcgtacccgtgccgtgggcctcgaccacatccacctcgtgcgcggcgaggccggcgttactgagagcggcttggatcacccgctgctgggaggggccgttcggcgcggtcagaccgttggacgcgccgtcctggttgaccgccgagctacggaccaccgccaacacctgatggcccttggcctgggcgtcggaaagtcgctctaccagcagcacaccaacgccttcagcccatcccgtgccatccgcgctgtctgcgaacgccttgcaccggccatcggaggccagaccacgctgccgcgagaactcggtgaagagctccggcgtggccatcacggtgacaccgccgaccagggccagcgagcactctccctgccggagggcataccccgcctggtgcagggcgaccagcgacgacgaacacgctgtgtcgactgtgaacgcggggccttcgaggccgaagaagtacgacacccggccggacaggacactggtcgcgctggcggtggccgcgaagccgccgaggtcagcaccggcaccgtaaccaccggggtacgcgcccatgaagacgccggtgtcgctgccgcgcacggaaccgggctcgatcccggcccgctcgaacgcctcccaggacacctccagcaccagccgctgctgcggatccatcgccaacgcctcacgcggactgatgccgaagaatccggcatcaaagccagccgcggcatccaggaagccaccctcagcacggtgcgattttccagccatgtcgtacaggttctcgacgtcccagccacggtcggtggggaaaccggagaccgcatctgtacccgactccaggagacgccacagatcctcaggcgacgagactccaccaggtaggcggcaggccattcccacgatcgccagcggctcgtcctgcgccaccgccgacaccggcccgcgtaccggtacggggttctcgccggtgaacaactcccccagccgaacagccaaagccgtcggagtcggatagtcgaacaccaacgtggcgggcagccgcaaccccgtcgccttcgccagactgttccgtagttccaccgcagtcagcgaatccacacccagatccctgaacacggcggctacggagacggtgctggtgtcggcgtgtcccagaaccgtcgcggcactgtcacacaccagcttcagcagtgccttctcccgctcggccggtgccagggcggccagccaccgcgctccaccggcggcagcggcccgccgagcaatcgggcggtgcaacgaccgcagcaatgccgggacttccgcgtcccgtaccggctccatcggcgcggccaccagaaccggttcactgtggcgtgacgcgctgtcgaacagccccatcccgtgctcggcggagatggcccgcaggccaccgcgccggatccggtcacggtccgtgtcggtcagttgcgcggtcaggccactggcgtcctcccacagaccccaggccaccgcgagtgcgggcagaccctcagcgtgacgctgctcagccagcgcgtccaggaacgcattggccgccgcgtagttggcctgccccgcactaccgagcacaccggcggcggaggaatacatgacgaacgcggccaggtcggcatcccgggtgagctcgtgcaggttccacgcaccgtcggccttgggccgcagtaccgtctccagccgctgcacggtcaaagactccacaacaccgtcatccaccacgcccgcggtgtgaatcacggccgtcaggggatgctccggcgagacacccgccagcacctgcgtcagcgcggcaggatcggacacgtcacaggccgctgtctcgacccgggcccccagttcaccaagctcgccgatcagcgcctcatccggggcgctgcgggacagcagcaggagatgacgcacgccgcgttcggtcaccaggtgccgggcggcgatccccgccagcacacctgaaccgcccgtgatcaggaccgtgccatccggatcccacgtcctttcaggctcaggctcttcggcatgtgtgcgggtcagccgtggtacttcgtaccggccgtcgctgacccgcagccgcggctcatccagtccgaccgccgccgccagctgatcctgggtgagggcgtcgtcgctttcgaccaggacgaaccggccggggtgttcggactgggccgagcgcatcagccccgacaccccagcagcggccaacccggtgccggtccgcaccaccagcgtgctgtcgctgaagcgctccccgccaagccactcctggagtgtgtggaggacctgagcggtcagctttcgtgtttgctccagcggatcgtcgctgtcggggagtgcggtgaagaccgccacctcgggtaccggcacatcgccgtccgccgccaggtcttcaaacgcacccaccgtcaggccggtctgctggggggtggggattcctgcccaggtcagggtgagcaggtcgtcggtgctggtggccggttcgtatacggggacggtgcgcagggtgagcgagcgggcggtcaggacggggaggcctgtgctgtcggtggcctctgccgacagggtgccgtcatcgtgtgaggtgaggcggacgcgcagctcgccgggattgccggcgtgcagggtcaggccctgccacacggcgggagtctcctcgcctacggtggtgagcgcggcggccatcagggcgggatgaagcacaaacctggtggcatcatgggcatcgtccagggccacctcggcgaagatgtcgctgcccaggcgccacaccgcccgcagtgagggtgccgatgtcccgaccgggaccgcaccggccggcggccacaccccaccggcctgccagccgaccgcggcagcggccacacccgtagtggtggccagggttgcggtggccaagcaggtccagggctcgccgtcaccgtaacgggcgtggacactgagccggcgccgaccgccctcatccggttcgcccacccaggtctgtacctcgacggcgccatcatcgggaagcagcagcaacgcttccacactcagatcctcaaccagaccgcagccgacctcgtccgccgctgccagcgccatctccacgaacaccgtcgcgggcagaaccgtctggtcccgcagccacagatcaccgctccgggaaacccgggcagtgaacaacaccccactggcctcggccagccgcaccaccgaacccagcaacggatgaccacccgcagtcgcccggtccgtgccctcaagccagtaccgctggtgctggaaggcgtacgtcggaagatccagcacccgggttaccgggacatcacccagcaccgcggaccactcgacactcacgccgttcacgtacaggtgagccagggcaccgacagcggcctgcgcctcatggtcaccgtgcagcatcgcgatgccatcgaccaggcgggccagtgaccggtcggcacccagctcgacgaacaccgcatcctcgaacgaggccacctgctcgccgaaccggaccgtgtcccggacctgccgcacccagtactcagcggtcatcacctgatcaccagcggccatggcgacctgcggcgtccggtaggtcaggccttcagcgaccgcccggaactcctccagcatcggttccatacgggcggaatggaacgcgtgactggtcggcagccgcgtccacttccccagcccctccgcggcctgcagcacggcggcctcatcaccggagagaaccaccgacgacggcccgttgaccgcggcgatctcaacaccctcacccagcacggcccgagcctcatcctccgagaccgggacagcggccatcaccccacccgcaggcagagcctgcatcagacgagcccgcgccgacaccaaagtgcaggcatcctccaacgaccacaacccggagacgtatccggcggcgagctcaccgacagagtgaccgaccaccgcatccggccgtacaccccacgattccagcaacccgaacagagccacctgcaaagcgaacagggccggctgggcatacccggtctcattcacatcgagatcgggcacatccagcagatcccacacctgctgatggatccgcgcgaagacggggaacgcggcggccagttcctcacccataccagcacgctgcgacccctgacccgggaagacgaacaccacccgcggatcggtcgccgcggtaccggtgacggtgtcatctccaatgagtacggcccggtactcgaacaccgaccgtgtcatcgccagcgtcgatgccacagcccgcgtatccgccccgggcgacgccgccagatacgcacgcaaccggccctcgtattcagccagtgccgactgggtcctcgccgaaatcaccaacggcacccactccggtgccgactcgaccactgtgttgcccgcaggctgtgtggggagtgcgctttccaggatgacgtgggcgttggtgccactgatcccgaaggacgacacacctgcccggcgaggccggtcggtgccgggccagggctggttctccgtcacgagctgcaccgcgcccgccgaccagtccacatgccgtgacggctcatccacatgcaacgtacgcggcacgaaaccgcgctgcagcgccatcaccatcttgatgacacccgacacacccgcagcagcctgcgtatgacccagattcgacttcaccgaacccagcagcaacggctgctcacgatcctggccataggtcgccatcaacgcctgggcctcgatcgggtcacccagcgtcgtacccgtgccgtgcgcctcgaccacatccacctcagccgtactcagacccgcgttgctgagagcggcccggatcacccgctgctgcgaaggaccattcggcgcggtcagaccgttcgacgcaccgtcctgattgaccgccgatccccgcaccaccgcaagcacctggtgaccgttacgacgggcatcggaaagccgctccaccaacagcacaccgacgccctcggagaagccggcgccgtccgcactgtccgcgaacgccttactgcgaccgtcaccggccaggccaccctgacgagcgaactccacgaaagtctgcggcgtggccatcacagtgacaccaccgaccagggccagcgaacactcaccctgccgcagggcataccccgcctgatgcaacgccaccaacgacgacgaacacgccgtgtcgaccgtgaacgccgggccctcaaatccgaagaaatacgacacccgacccgacaggacactcaccgcaccggcagttgtcccgaagccgccgaggtcggcaccgatgccgtagccaccggggtacgcacccatgaaaacaccggtatcagttccgcgtacggaaccgggcttgatcccggcccgctcaaacgcctcccaggacacctccagcaccaaccgctgctgcggatccatcgccaacgcctcacgcggactgatcccgaagaacgaggcatcgaaaccagccgcggcatccaggaagccaccctgcaagcgataggagttgccgactgcggggccgaacagattctccacatcccagccacgatcggtggggaatccggagaccgcgtccgtacccgactccagaagacgccacagatcctcaggcgacgacaccccacccggcaaacggcacgccatacccacaatcgccaacggctcgtcctgcgccaccaccgacaccgacgtacgtaccggtgcagggttctcgccggtgaacagctcctccaaccgcgcagccaaagcggccggggtcgggtagtcgaacaccaacgtggcgggcaaccgcaaccctgtcgccttcgccagaccgttccgcagctccaccgccgtcagcgaatccacgcccagatccctgaacgcaccagtcgccggaatcgtgctggcgtcggcatgtcccagaaccgtcgcggcgccatcacacaccagcttcagcagcgccttctcccgctccaccggcgccaaccgggccagccactgcaccgacgaatcaccggtagaagcagcccgccgggcaaccggacgatgcaacaaacgcagcagcgccggaacctcgacatcacgcacaggctccatcgacgcagcgagcagcaccggctcaccatgacgtgacgcggcatcgagcaagcccatcccccggcccgcggagatcgcccgcaggccaccacgccggatccggtcacggtccgtatcggtcatcttcgcggtcagaccactggtgtcctcccacagaccccacgccaccgccagcgcgggcagcccctcaccacgacgctgctcagccagcgcatccacgaacgcattggccgccgcataattaccctgccccgcactaccgagcacaccagcagccgaggaatacatgacgaacgccgccaggtcggtgttctgggtgagttcgtgtaggtgccaggcgccgtcggccttgggccgtagcaccgtgtcgagctgttgtgtggtgagggattccacgacgccgtcgtcgagtgcgccggcggtgtggatcacggcggtcagggggtgttcgggtgatacgcccgccagtacgcgcgccagcccggcacggtccgacacgtcgcaggtggctgtgtcgacgtgggcgcccagctcggcaagctccttgatcagtgcttggtcgggggtggtgcgggacagcagcaggaggtgacgtgcaccgtgttcggctgccaggtggcgggcgaggatgcctgccaggacgccggagccgccggtgatcaggatggtgccgtcggggtccggccggcgggggatggtgaggacgatcttgccgatgtggcgggcgcggctcatccagctgaacgcatcgcgggcctggcggatgtcccaggcctgcaccggcaggggcagtaggacgccttgcgtgaacagggtgaggagttcggtgatgatttcccgtagccggtccgggccggcgtccatcaggtcgaaggcctggtaggtggtgcccggccggtcggcggtgacctggtgcgggtcacggatgtcggtcttgcccatctcgatgaaccggccgccgcggggcagcaggtcgagggaggcgtcgacgaagtcaccgctgagggagttcaggacgacatcgacgccctggccgtgtgtgttgttgaggaaggtttcctggaaactcagtgtgcgggagtcggcgatgtgggtgtcttcgagaccggcttcgcgcaggatgtgttgtttcccggtgctggcggtcgcgtagatccgcgcgccgaggtggcgggcgatctgggtggctgccatgccgacaccacccgcggcggcgtggatcagcacggactcacccgcactcagcccggccagatccaccagcccgtagtacgcggtggcgaacacaaccgggacggacgccgccgtagtgaacgaccacccgtcaggaatcacacccagcattcggcgatcagcgatcgcggaccgcccgaacccaccgcccacaagaccgaacactcggtctcccggggccagatcctggacctccggaccgacctcgagcaccacgcccgcagcctcaccgcctgccaggcgtttgtcgtcaaccatgccgagggccacgacgacgtcgcggaagttgagtcctgcggcgcgtacgtctactcgtacttcaccggattgcaggggccgttcggcggtgtcggtgggtaccagagcgaggtcccgcaaggttccgctgcggggttgttccaacagccaggcacgactgtcggggatcgtcagcgggctgctttccggcgtattcgcccgcgccagccgcggtacctcgaaccggccgtcgcagacccgcagccgcggctcgtccaatccgacagtcgccgccaactggtccggggtgagggtgtcgtcgtcgcattccaccagaacgaaccggcccggatgctccgactggaccgaacgcatcaaccccgacaccccggcggcggccaaaccggtaccggtccgcacgaccagcgtgctgttcgtgaagccttccccggccagccatgcctgaactgcctggagaacctgggcggtcaacgtgcgagtctgtgccagcgggtccagcgggtccagcggagtctcgctgctgccgggaagtgcggtgaacaccaccacctcgggcaccggcacatcaccacccgacaccagatcctcgaaccggccgaccgtcagaccggtcccctgaggagccgggatctccatccacgtcagggcgagcagctcatcggcagcggaaccaagcgcgtcggccgtcaccacccgtgtcacgagcgaaccgacgctagccactggccggccactgtcgtcagcgaccagcacactccagccgtccgctgttcgtgttatcgcgacacgcagcatcaccggccctgtggcgtggacccaaacctggttccaggagaacggcagccgcacaccctgctcggcggtgtcgagtgtgctcaaattgctggcgtggagggcggcgtccaacagcgccggatgcaccgcgaaccgtgccgcctcctgcgcctgctcctcagccagagcaacctcggcgaagacggtgttgccgtcgcgccacgcagtccgcagcccctggaacgcgggaccgtactcgtaaccggccccagtcagctggtcgtagaaatcactaaggtcaagcggctctgcccctgccggtgggggccaagcagcgaactccggctgcgagaccgtcgagtcagaggtgctgactgtcgccgtgacgtgccgggtccacgtatcggtgttgtccgcctgggagaagaccatcaccgcgcggtgcccggactcgtcggcctcggcgaccgatacggacatttgcacaccgccagtctgcggcagcaggagcggggtttcgatcaccagctcatcgacaacgtcacaccccacctcgccggcggcgcggacgaccagctcaacaaatgcggtcccgggcagcagcacactgccccgcaccgcgtgatcggccagccacgcatgcgtggccagcgacacccgcccggtcagcaccacaccatcggagccgggcagcgccactaccgtgcccagcagtggatgaccatcggcagccgcccggtccacgcccttgagccagtaccgctggtgctggaacgcgtacgtcggaaggtccagcacccgggctgcggtggtacccagcaccgcaggccagtcgacagtcacgccctcgacatatgcctgcgccagggcggtgagcatccgggtggcgtccccgtcgtcacgacgcagcgtggcaaccgtgacgacatcgtcgtccatcgcctgcaacaacaccgggctggcgctgacctccacgaacacggtgtcaccctgggcctgcaactggccggcggcgggctcgaaacccaccggctcacgcaagttccggtaccagtactccgcgtccaaggggccttcgacccacgtcccatccaccgtcgacagccacggcaccaccggagcccgcgaatcaacaccggcgatgacacccagcagctcgtcacggatcagctcgacgtgcggggtgtgcgaggcgtagtcaacggcgatccgccgcacccgcaccccccgcgcctcatgaaccgccagcacacggtccaccgcctccggcgcacccgcaaccaccgtagacgcgggaccattacgagccgcgacccacgccccgtcgaccagctcgacatcctgcgcgggcaacgcaaccgatgccatcgcaccccggcccgccagcccccgcgcgatcacctgactgcgcaacgtcacaacccgcgccgcatcccgcaacgacaccgcacccgccacacacgccgcggcgatctcaccctgcgaatgaccgaccaccgcatccggccgcacaccggccgcctgccacaccgcggccagcgaaaccatcaccgcccacgaagcaggctgaaccacatcaacccgggccaccaccgccggatcatccagcacggcgaacagatcccagtccacgaactcactcaacgccgccgcacactcggccatccgctcggcgaacaccatcgacgaagtgcgcagcgcactgcccatccccagccactgccacccctgacccgggaaaacaaacaccacccgaggatcagacacagcggtgccggtgccggtgacgctgtcatcccccagcagcacggcacggtgctcgaacagcgaccgcgtcaccgccagcgtcgaccccacagcccgcacatccgccccgggcgacgccgccagatacgcacgcaaccggccctcgacctcggccagagcaggcaacgacttcgccgacaccaccaacggcaccagctccgaatccactacgggtgttgagccggccgcgtcgtccacggactgtgccggtgcaccctccaggatgacgtgggcgttcgtaccgctgaccccgaaggccgacacacccgcccggcgcggccgaccggtggcgggccaggaccggttctccgccaccagctcaaccgcgcccgccgaccagtccacatgccgcgacggctcatccacatgcagtgtgcgcggcacgaaaccgtgccgcagcgccatcaccatcttgatgacacccgacacacccgccgcggcctgcgcatgaccaatgttcgacttcaacgaccccagcaacacaggctgctcacggtcctggccgtaagtggcgatcaccgcctgggcctcgatcgggtcacccagcgtcgtacccgtgccgtgcgcctcgaccacatccacctcgtgcggcgccagaccggcgttgctgagagcggcccggatcacccgctgctgcgaaggaccgttcggcgcggacagaccgttcgacgcaccgtcctggttcacagccgagccccgcaccaccgccaacacctggtggcccttggcctgagcatccgacaagcgctccaccagaagcacgccgacgccctcggcccactccgtgccatccgcggcgtcggcgtaggctttacaccggccatcggctgacaggccgcgctggcgggagaactccacgaaactttgcggcgtaggcatcaccgtgacaccgccgaccagggccagcgagcactcaccctgccgcagggcataccccgcctggtgcaacgccaccagcgatgacgagcaggccgtgtccaccgtgatggcggggccttcgaggccgaagaaatacgacacccggccggacaagacactcgccgcaccagcggtcgcgccgaaaccctcaaggtcggcgccggcgccgtagccgccggggaaaccgcccatgaagacaccggtgtcgctgcctcgcacggagccgggctcgataccggcccgctcgaacgcctcccaggacacctccagcaccagccgctgctgcggatccatcgccaacgcctcacgcgggctgatcccgaagaacgaggcatcgaagccggccgcggtgtccaggaagccaccctgcacgcagtacgacttcccggacgcgtccgggtccggatcgaacaggccgtcgacgtcccagccacggtcggtgggaaaaccggaaatcgcgtccgtacccgactcgaccaagcgccacagatcctccggcgacgacacaccgcccggcagacggcacgccatacccacgatcgccaacggctcgccttgccccaccgccgacaccgcgcgctccggggcggggctctcgcccgtgaacaactcccccaaccggacgacgagcacggccggggtcggatagtcgaacaccaacgtggctggcagccgcagacccgttgccttggccaggctgttgcgcagttccaccgaggtcagcgagtcgatgcccatctcgcgggacgtcttgtcaggggcgtaccgatcggccgcggagaggcccaggatgtccgtgacgctgctgcggacgagatcgcgcaacgcctgttctctggcagcctccgcggctaggaactgccgcgaccatgcctgctgttcggtggtgtcggtgtgcgcaccgaccaagttctggaggagcgggggaagcgtgtcggccgcggccagtgctcgcagaccgacggtgttcagacgggtgacgatgtgcgccgagtcggcggaagccatcgcgcggcccagcaggggtcccctgaccacgaccgcttcggcttcgggtatgccccaggcgatcgccgtgatcggcaggccttcggcgcggcggctccgggcgagggcgtccacggaggcgggcgcgtcttggctgaagacgacgaaggcggcgaggtcgaggcctttcgtgaggcggtgcagctggtggctctcgtgggcaacggcgggaccgccggtgtggatcactgcggtgagagggcgttccggtgctatcccggccagtgtccgcaccaggccggcacgatccgacacgtcacagaccgccgtgtcgacccgggcgcccgactcgatcagctcgttgatcagtgcttcgtccggggtgctgcgggacagcagcagcagatgacgcacgccctgttcggccaccagatgccgggcgacggttcccgtcagggcgcctgctccgtcggcgatcaggaccgtaccgtcggggtcgagtcgccggggaatggtgaaggtgatcttgccggtgtggcgggcgcggctcatccagctgaacgcgtcgcgggccttgcggatatcccaggtcagtacgggcagcggccgcagcacgccctgtgcgaacagttcgagcagctcggcgatgatttcccgcagccggtccgggccggcgtccaggaggtcgaacgcttgataggtggtaccaggccggtccgcggtgatccggtccgcgtcgcggatgtcggtcttgcccatttccaggaaccggccaccgcggggcagcaggtcgagcgaagcatcgacgaagtcaccgctgagagagttgaggacgacgtcgacaccctggccgtcggtggtgttcaggaacgcttcccggaatgcgagtgtgcgggagtccgcgatccgggtgtcctccaggcccgcctcacgcaggatgtgctgcttggccgcgctggcggtcgcgtggatccgcgggccgaggtggcggcaagcactctgggtcgctgccatgcccacgccacccgccgtggcgtggatcagcacggtctcacccgcactcaacccggacaggtccacgagcccatagtaggcggtggcgaacacgatggggatggacgccgccgtcgtgaaggaccacgtatcgggtatcgcaccgagcagacggcgatcggtgatcgcgacccccccgaacgcacttcccacgagcccgaagacccggtctcccggggtcaggtcgtgtacttccgggccgacctcgagcaccacgcccgcggcctcacctcccatcagtccctcacctgggtacgtgcccagagcgatgagaacatcccggaagttcagacccgcggcgcgcacggctatccgcacctcgccggggcgcaagggccgctcagcggtatcggcgggtaccagggcgaggtctcgcagggttccgctgcgggagtgctccagcagccacgcacggtcctcggggatcgtgagcgagtcgctgtccgcggtgttcgcgtgggccagtcgcgggacgagcggattaccgtcgcgcagcgcgagctgtggttctccgagcccggcgagggcccgcaggagggtgtcgtcggggtcggggtcggcatcgtcgaagtcgacgtcgatgacgacgaagacgccggggttctccgtctgttcccggcggatcgcgtcccacgccgctgcgtgctcggggaccgggaggtcggagggaccagtgtgcacggcacggcgggtgacgaagacgagtgtcgaatcggcacgccgcttgtcggcgagccaggactgcgcgagatcgcggaccgcgccggccaggtcggcggcgtcggacggcagggagtcgacgcgtacgaccacatggcggccgtccggggaggcctgtttcggcgggtcgaggggaatccactccagccggtgcagggtttcgccgccgctcgctccggcgagcaattcggccggtttctccgtgagggaggagcgcttcaccttgccggacgcggtccgcgggatggcgtcgacccggtagatctcctctggcaccttgaagtacgacaaccgttcgcggcacacggcgagcaccatgtcagtgtcgacaccgcccgtttccggcacgacgtacagcacgggaatctcgccgagtacggggtgctgcttgcctgccgctgccgcatccttgaccccgggcacgtcgagcgccactgcctcgatctcgtgcgggtggatgttctcaccaccgcggatgatgagttccttgatccggccggtgatggtgacgtgtcccgtctcgctgcggcgggccaggtcaccggtgcggtaccacccgtccgaaagcacctctgccgtggcttcgggctgctcgtggtagccgatcatgatgctcggtccgctggcccacagttcgccctcttcgccgtccgcgacgtcggcgccgctgatgggatcgacgaagcgcagggacagccccgggacggggaggccgcacgaaccggggatccgttggccgctgagccagttgacggtgagggatccgctggtctcggtgcagccgtaggtgtcgagcagcggtacgccgaagacgtcctcgaagccctcgatgagggaagccggcgcgacggagccggcgaccaggcccattttcagcgacgacgtccgtggttcgaacgtgtcggcggctcccaggagatagcgggacatcgtcggcacgccgacgagcacggtgcaccgatgctccgtgagctcttcgagcacctcgctcgccacaaagccgttcatgatccgcgcagtggcgccgacggcggtggtggccaagagacacaggtggagggcgagtctgtggaacagcggcgcgggccagagcagaacgtcgttctcggtcagctcccaggcggggatatcgcaatacgccgcggaccagaggccgctgccctgggtcgacaggacgcccttcggggtgcccgtggtgccggaggtgtagagcatccaggctggttcatcgagccccaggtcgtcgcgtggcggccggaggggctcggtggtggccagctcggcgaatgaccgtactcctgggggagttcgttcctcgcccaccagaacgatgttcgctgcgggggccgtgcgacgcacatcgtcgagatgagcggagtcggtgatgacggctacggcgccgctgtccgacaggaagtgggcgacctcggcctcggtcgcgtccgggttgagcggtacggcaaccgcgctggcccgggcgatcgccagatagctttcgatgttctcgacgcggttccccagcaggatcgcgacccggtcgccccggtccacacccatgtccaccaggtgcccggcgatccgtccggtccgcgtggccagttcggcatgcgtcagtgcgagccgcgagtccacgtacgctattttgtcgccgagccgttcagcattcgcgcgaagcagatcataaataggccgtaccagttccgcgcgtgaca

SEQ ID NO: 159 - DNA, 25532 bp, Artificial Sequence
  Plasmid
tatgtgtcctccttaattaatcgatgcgttcgtccggtggtcgtcgtcatcgtcggccccgtggctcgaaggaggctcgaaggccgatacgggacccctcgatgccggatccaccggcgccgcgtccagcggcaccccatctcccttcgaccgccgctcgagccgggcgcccaaagctgagcgcgtgagggaccacgaggcagggaggggaacacttaagaggggctccaccgcgttcacggaccggtgctacacgagcaccttctcaccgttgagaatttccatgtgcatacgctggatttccggcgtcggatccacccccagttcgtcggacagtatccgccggagattccgatacgattccagcgcctcggcgcgcctgcccatctgacagagcgcgcccatcagtttggcgtgcagggtctcgttcagcggatgcgaaattaccagggaccggagttccggaatcatcggccctattctgcccagccgccaattcgcgtcgatacggagctgcattccaaaaagccgcagctcttccaggtgcgcgatattgctttcgagcacccggccgcacggtacggtggacagcgccgggcctcgccagagatccagtcccgcgtccaacgaggcgagcgcctcctcgagccggttctcctcgagcagccggccgccggtgcggatcagacgctcggcgaccgcgacgtcgagttcgtcctcgtcgatcagggcgaagtagccgggcggctgggtcaggaccaattcccggtcgtcgctcgtcacccggtgctcccccagcagccggcgggtgtggtacacgtacgtctgcagcgtcgtcatggcgctgcggggcgggtggtccgcccacaactcctcgatgagcacccccgatcccaccacctcgtgccgcctgaggagcagcagcaccaggagctgggtcgccttcgaggatttaagcggaattacacatcccgcatcggtgattacatggacacgtcccaataagttgaatctcatctgcgcccccgtcgagattctccgtctcctgggggcgacaataacaggcctactcaacagatttcaatgtgcttgccgtcacaagcgatctcctattgatcaaaaattaatcagtgcagcgagctgcactgattaatttttgctggattttaccgagaggcagtggactagtttactggcgtaatagcgaagaggcccgcaccgatcgcccttcccaacagttgcgcagcctgaatggcgaatggcgcctgatgcggtattttctccttacgcatctgtgcggtatttcacaccgcataaattccccaatgtcaagcacttccggaatcgggagcgcggccgatgcaaagtgccgatcaacataacgatctttgtagaaaccatcggcgcaggtatttacccgcaggacatatccacgccctcctacatcgaagctgaaagcacgagattcttcgccctgcgagagctgcatcaggtcggagacgctggccaacttttcgatcagaaacttctcgacagacgtagatcaggcttcccgggtgtctcgctacgccgctacgtcttccgtgccgtcctgggcgtcgtcttcgtcgtcgtcggtcggcggcttcgcccacgtgatcgaagcgcgcttctcgatgggcgttccctgccccctgcccgtagtcgacttcgtgacaacgatcttgtctacgaagagcccgacgaacacgcgcttgtcgtctactgacgcgcgcccccaccacgacttagggccggtcgggtcagcgtcggcgtcttcggggaaccattggtcaaggggaagcttcggggcttcggcggcttcaagttcggcaagccgctcttccgccccttgctgccggagcgtcagcgctgcctgttgcttccggaagtgcttcctgccaacgggtccgtcgtacgcgcctgccgcgcggtcttcgtacagctcttcaagggcgttcagggcgtcggcgcgctccgcaacaaggttcgcccgttcgccgctcttctcaggcgcctcagtgagcttgccgaagcgtcgggcggcttcccacagaagcgccaacgtctcttcgtcgccttcggcgtgcctgatcttgttgaagatgcgttccgcaacgaacttgtcgagtgccgccatgctgacgttgcacgtgccttcgtgctgcccaggtgcggacgggtcgaccaccttccggcgacggcagcggtaagagtccttgatcgattcttccccgcgcttcgaagtcatgacggcgccacactcgcagtacagcttgtccatggcggacagaatggcttgcccccgggaaagccccttgccgcgccccctgccgtccaaccacgcctgaagctcataccactcagcgggctcgatgatcggtccgcaatcaagctcgaccggccggagcgtgatcgggtcgcgctgaatgcggtaaccctcaatcttcgtggtcggcgtgccgtccggcttcttcttgtagatcacctcagcggcgaagcccgcaatacgcgggtcccgaaggattcgcataacggttgccgggtcccaggcgcttgaagcggtcttcttcccaatcgtctcgccccgggtcggcacggcgtcagcgtccatgcgcttacaaagccccgtgatgctgcccgggtgaatggcggcttgactgcccggcttgaagggaaggtgtttgtgcgtcttgatctcacgccaccaccaccggattacgtcgggctcgaactcgaagggtccggtaaggggagtggtcgagtgcgcaagcttgttgatgacgacattgaccattcggccgttgcgcgtgatctccttcgtctccgaaacaagctcgaagccgtaaggcgccttcccgccgacgtacccgcccaattcgcgctgaaggttcttcgtgtcgagaatcttcgccgacttcagcgaagattctttgtgcgacgcgtcgagccgcataatcaggtgaatcaggtccatgacgtttccctgccggaagacgccttcctgagtggaaacaatcgtcacgcccagggcgagcaattccgagacaatcggaatcgcgtccatgaccttcaggcgcgagaagcgcgacacgtcatagacaatgatcatgttgagccgcccggcgcggcattcgttcaggatgcgttcgaactccgggcgctccgccgtcccgaacgccgacgtgcccggcgcttcgctgaaatgcccgacgaacctgaaccggcccccgtcgcgctcgacttcgcgctgaaggtcggccgccttgtcttcgttggcgctacgctgtgtcgctgggcttgctgcgctcgaatttcgcgctcgcgcgactgacggtcgtaagcacccgcgtacgtgtccaccccggtcacaaccccttgtgtcatgtcggcgaccctacgcccccaactgagagaactcaaaggttaccccagttggggcactactcccgaaaaccgcttctgacctgggaaaacgtgaagccccggggcatccgctgagggttgccgccggggcttcggtgtgtccgtcagtacgggccatagaggggcgtcgtgtaacccacccagggcgattgctccggcacggggaagccgcgccacgccttcgggacgtcatggcaatcgctagagcttgcatgcctgcaggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctggcggcctgctgaaactctggctcaccgacgacccgcgcacggcgtggttcggtgatgccacgatcctcgccctgctggctgaagatcgaagagaagcaggacgagcttggcaaggtcatgatgggcgtggtccggccgagggcagagccatgacttttttagccgctaaaacggccggggggtgcgcgtgattgccaagcacgtccccatgcgctccatcaagaagagcgacttcgcgaagctggtgaagtacatcaccgacgagcaaggcaagaccgatccccggggacctgcaggtcgactctagctagctggccagggcccgatacgtcgcggtgagttcaggctttttcatatctcattgcccccggacgagcgtctgctccgccattcgccgtccgccgtgccaatcggatcagccgtccaaatgcgggattttcgttagtcggaggccaaacggcattgagcgtcagcatatcatcagcgagctgaagaaagacaatccccgatccgctccacgtgttgccccagcaatcagcgcgaccttgcccctccaacgtcatctcgttctccgctcatgagctcagccaatcgactggcgagcggcatcgcattcttcgcatcccgcctctggcggatgcaggaagatcaacggatctcggcccagttgacccagggctgtcgccacaatgtcgcgggagcggatcaaccgagcaaaggcatgaccgactggaccttccttctgaaggctcttctccttgagccacctgtccgccaaggcaaagcgctcacagcagtggtcattctcgagataatcgacgcgtaccaacttgccatcctgaagaatggtgcagtgtctcggcaccccatagggaacctttgccatcaactcggcaagatgcagcgtcgtgttggcatcgtgtcccacgccgaggagaagtacctgcccatcgagttcatggacacgggcgaccgggcttgcaggcgagtgaggtggcaggggcaatggatcagagatgatctgctctgcctgtggccccgctgccgcaaaggcaaatggatgggcgctgcgctttacatttggcaggcgccagaatgtgtcagagacaactccaaggtccggtgtaacgggcgacgtggcaggatcgaacggctcgtcgtccagacctgaccacgagggcatgacgagcgtccctcccggacccagcgcagcacgcagggcctcgatcagtccaagtggcccatcttcgaggggccggacgctacggaaggagctgtggaccagcagcacaccgccgggggtaaccccaaggttgagaagctgaccgatgagctcggcttttcgccattcgtattgcacgacattgcactccaccgctgatgacatcagtcgatcatagcacgatcaccggcgctgttgcaaatagtcggtggtgataaacttatcatccccttttgctgatggagctgcacatgaaccaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagatttctagcttggattctcaccaataaaaaacgcccggcggcaaccgagcgttctgaacaaatccagatggagttctgaggtcattactggatctatcaacaggagtccaagctcagctaattaagcttagtgatggtgatggtgatgagatctggtctagatttattcgttcctggtcctccattttgccgagagctgttccagcagttcggaaatggccttatgttccgccgcggtcatgtcgacggcttctgcgtccagttcgttgatctcttccagcagcgcataaacgccggccgcgtcgatgtcggaatcaagcaacgcatccaagtgcgcggccaattccgccgacgtggggtgctcgaagagaagcgtggacggtagatcgagtccggtggccttcgacagccggttgcgcagccgaacggcgctgagcgagtcgaatcccaactccaggaaggacgagtcgtcgagtatgacgccggggtcggccatgcccaggaggctcgccacctccatgtgaacgagttccagcatggtgcggggctcatccgcataggagggctcgtcatactcgccgccctcctcctcgaccacgggcgccacagctgtggcatccggggcggccggggccagccagtaggactggtgctggaacggatagaccggcagatccaccgcccggccgccggacaagaccttcgcccagtcgattgccgtcccgcccgcgtgcaactccgcgatggccgtcatcagacagacgtcctccggcgaccgcgggcgtagcacggcgtggaacgaggcgtcgccgcccagacactccactccggccgacgcgagcgcccccgaaggccctacctcgacgaatgtgcccacaccctgctcggccagttcgcggacggcgtcctggaagcggacgggtcgccggacctggcgcaaccaatactccggcgtgcccatctcatcctggtcgatcagacgcccggtcacggtcgataccacgggcagcgcaggggcacggaacttcagggactccagtgccgtacggaactcatccagcacggcctccacatggcgggagtggaaggcatggcggaccttcagtttcctggcctcccgcccggacgccgtccacgcggcctcgaagtccgccaccggctccggctcacccgacacgacgacggcctcggggctgttgaccgccgccagatccagcgccgcaccggtccggctgaggaactccctcacctcttcctcacctgcccgcagcgcgaccatggctcccggcggtgtcgtccgcagcgctcgaccccgggcgacgatcagagtggtgacgttttcgagcgagagcatcccgctggcgtacgcggcggttgcctcaccgatggagtgcccggcgacgaagtcggggcgcacgccccagtcctccagcagcccgaaaagcgcggcctccatcgcgaaaatgcccgcttgcgcgtagagggtgtcatccacgagcccggccgtcgtcgaaccgccctcaccgaagcagacgtccgtcagcgagtggtcgaggtgcttgtcgaacccggcgctcaccgtgtcccaggcacgtgcgaaggcggggtagctgtcgtacagctccttgcccattcccagccgttgggtgccttgcccgtcgaacaggaaggcaacgcgccgggccttggcggtcgcggtcgcggtcgtgagcccgggccaaggggcgccgtccgccagcttggacagcgcgcgcaggaagtcctcccggccggatcccaccgcgactgcccggtgggcgaagtccgatcgtgtggtcgccagggagtatccgatgtccagcgagttccactccgagtccccggcgagggaggcgtacagccgcccggcttgctcccgtagcgctttcgggctctgcgcggacaagacccacggcagcggtccgggctcattcggcgtgaccggcgtgaccggcgtgaccggcggggcgggcgtgaccggcgtgaccggcggggcgggcgcctggtactgctccagcaccacgtgcgcgttggtaccgctgagcccgaacgacgacacgccggccctgcgcagcttggtgtcatccggccacggctggtgctccgtcagcagcgcgacgcttcccgatgtccagtccacgtgaggcgatggcgcgtccacatggagcgtacgggggagcgaaccgtgcgccatcgcctccaccatcttgatcacgctgagcacgcccgacgccgccatggcgtggccgatgttcgacttcagcgagccgagccaggcgggcgccgaccgctcttgcccgtacgtcgccagaatggcctctgcctcgatcgggtcgccgagcttcgtgccggtgccgtgcgcctcgaccacatccacgtccgacgcggtgagaccggcgttggccagcgcctgccggatcacccgctgctgggacgtgccgttcggtgcggtcagcccgttcgacgcgccgtcggagttcaccgcgctgccccggacggtggcgaggacccggtgccccagccgacgggcgtcggaaagccgttccaccaccaggacacccacgccctcggaccagatcgtgccgtccgccgacgcggcgaacgacttgcaccggccatcggacgacaggccgcgctggcgggagaattccacgaacatcgcgggcgaggacatcaccgagaccccgctcaccagcgccagcgagcactcgcgctgcctcaacgcctggctcgcgaggtgcagcgccaccagggaggaggagcaagcggtgtccacggtgacccccggcccctccaacccgagcgcgtatgacacccgccccgacagcaggctgaccgagctaccggtgatcccgttgtcgtgctgctggtcgacacccactccgtaaccctgtgccgcgccacccacgtacacgcccacatcgcgaccccggagggacttcggatcgatctgcgcgcgctcgatcgcctcccaggtggtttccagcaacagccgctgctgcggatccatgcccagcgcctcacgcgggcttatgccgaagaagggagcgtcgaagtcggccgcggtgtccaggaagccgccctgcacgcagtacgacttaccggcggcgtccggatccggatcgaacaagccctcgacgtcccagccacggtcggtggggaaaccggagatcgcgtcagtgccggactccacaaggtgccacaaaccctccggggaactgaccccgcctggcagccggcacgccatcgccacgatggcgatcggctcattcgccgacggctcatccgcgaccggatcggccgggccggtgaccgtgctcggcgccggagcttcgaggcgttgctgtacgggcgggatatcgagcttgcccagcagatgcgcggccagagcgttcgccgtcgggtagtcgaacaccatcgtggcgggaagctgcagcccggtctccgccacgaggcggttacggagttcgatcgccgtcagggaatccatgcccagatccttgaacgacgtgtccgtcgcgatcgcatccgccgagctgtggccgagtacggagcgcctctccagcacgagttcgagcatgatgcggtgctgctcgacgctcgtacggccggtgagacgggcgctcaggggctgcgagccgacctcgttgcgtgccgcggtcctggactgcggacgcttcaccgtttgaagtccgcgcagcagcgcggggacctcgacgtccccccgtagcggagacatcgccgcggcgaacaggaccggctcaccgtggcgtgacgcgccgtcgaacagccgcattccgtgctcggcggtgatggtgcgcatgccgctgcgccggatccgatcgtggtccgtgtcggtcagcccggaggtgaggccgctggtgtcgtcccataggccccaggcgagcgcgagtgcgggcaggccctcggctcggcgctgttcggccagggcatcgaggaaggcgttggccgccgcgtagttgccctgccccgcgccacctatgacaccggcggcggaggagtacatgacgaatgccgccaggtcggtgttctgggtgagttcgtgtaggtgccaggcgccgtcggccttgggccgtagcaccgtgtcgagctgttgtgtggtgagggattccacgacgccgtcgtcgagtgcgccggcggtgtggatcacggcggtcagggggtgttcgggtgatacgcccgccagtacgcgcgccagcccggcacggtccgacacgtcgcaggtggctgtgtcgacgtgggcgcccagctcggcaagctccttgatcagtgcttggtcgggggtggtgcgggacagcagcaggaggtgacgtgcaccgtgttcggctgccaggtggcgggcgaggatgcctgccaggacgccggagccgccggtgatcaggatggtgccgtcggggtccggccggcgggggatggtgaggacgatcttgccgatgtggcgggcgcggctcatccagctgaacgcatcgcgggcctggcggatgtcccaggcctgcaccggcaggggcagtaggacgccttgcgtgaacagggtgaggagttcggtgatgatttcccgtagccggtccgggccggcgtccatcaggtcgaaggcctggtaggtggtgcccggccggtcggcggtgacctggtgcgggtcacggatgtcggtcttgcccatctcgacgaaccggccgccgcggggcagcaggtcgagggaggcgtcgacgaagtcaccgctgagggagttcaggacgacatcgacgccctggccgtgtgtgttgttgaggaaggtttcctggaaactcagtgtgcgggagtcggcgatgtgggtgtcttcgagaccggcttcgcgcaggatgtgttgtttcccggtgctggcggtcgcgtagatccgcgcgccgaggtggcgggcgatctgggtggctgccatgccgacaccacccgcggcggcgtggatcagcacggactcaccctcactcagcccggccagatccaccagcccgtagtacgcggtggcgaacacaaccgggacggacgccgccgtagtgaacgaccagccatcaggaatcacggcgagcattcgacggtcggcgatcgcggccggcccgaatgagcctcccaccacgccgaagacgcggtctcccggggccagatcctgtacatcggggccgacctcgagcacgacgccggccgcttcgccgcccgtcggccggttgtcattgaccatgccgagggccacgacgacgtcgcggaagttcaggcctgcggcgcgtacgtctatgcgtacttcgccgggtcgcaggggctgttcggcggtgtcggtgggtaccagggcgaggtcttgcagggttccgctgcggggttgttccagcagccaggcacgactgtcggggatcgtcagcggggtgtcttcgggggtggtgttggtccgggccagtcgtgctgcctcgtaccggccgtcgttgatccgcagccgtggctcgtccagtccgacggtggcggccagttggcggagggtgagggtgtcgtcgtcgctttcgaccaggatgaaccggccggggtgttcggactgggccgaccgcatcaaccccgacacggcggcggcggccaacccggtgccggtccgcacgaccagcgtgctgtcggtgaacgttcccggcagccaggtctggaacggtttgaggacctggcggtcagtgtcgggctgtgccagtgggtccgcgggtccagcgggccgcggacccagtgggttctcgctgctgttggggagtgcggtgaagaccaccacgtcgggtaccggcatgttgccgtccgccaggtcttcgtacctgaccatgggcaggctggtctcctgggggggcgggattaccgtccatgtcagagtgagcaggtcgtccgtggtggagccgagtgtgtcggcggttaccggccgggtgatgagggagccgatggtggctacgggcctgccggtgtcgtcggcgacccgcagactccagccgtcggcttcctgtgtcaccgcgacccgcagcgtggccgggccagtggcatggacctggacgtggttccaggagaacggcagccccacaccctcctcggcgtcgggtgtgttcagggtgcaggcgtgcagggccgcatcgagcagggccgggtgcacgtcgtatcgtgccgcctcctgcgcctgctcctcggcgagagcaacctcggcgtagacggtgtccccgtcacgccacgcagcctgcagaccttggaaggcgggaccgtactcgtagccttctgccatcagccggtcgtagaagtcggccacgttcatcggctgggcctgggctggcggccaggtgtcagactccggcagcgagaggggtgtgtcagaggtgctgatagtggcggaaacgtgccggatccatgcgtccgtgttgtccgcctgggagaagaccgtcaccgtgcggtgtccggactcgtcggcctcggcgacggacacggacagttggacgcctccggtctgcggcagcaggagcggggtttcgatcaccaactcgtcaacgacgtcgcactcgacctcgtcggcggcgcggacgaccagttccacaaatgcggtcccggggagcaggacactgccccggaccgcgtgatcggccagccatgtatgggtggccagcgacacccgcccggtgagcaccacaccgtcggagccgggcagtgccactacggtgcccagcagtggatgaccgtcggcagccgcccggtccacgctcttgagccagtaccgctggtgttggaaggcgtaggtcggaaggtccagtacccgggttgtggtggtgccgaggatggcgggccagtcgacggtgacgccgtggacataggcctgtgccagggcggtgagcatccgggtggcgtcgccgtcgtcacgacgcagcgtggcaaccgtgacgacatcgtcgtccatcgcctgcaacaacaccgggctggcgctgacctcgacgaacacggtgtcgccctgggcctgcaactggctgacggcggggtggaaaccgaccggttcacgcaggttccggtaccagtactccccgtccagcgggctgtcgacccaggtgccgtccacggtcgacagccacggcacgagcggggtctgcgagctgctgtcgctagtgatgtcgagtagttcgtcgcggatcagctcgacgtgcggggtgtgcgaggcatagtcgacggtgatccgccgcacccgcaccccttgtgcctcatgagcggtgaggacatggtcgaccgcttccggggtgcccgcgatcacggtggaggcgggcccgttgtgggcggcgatccaggccccgtcgaccagctcgacatcctgcgcgggcagggcgacggatgccatcgcgccccggcccgccaggccccgggcgatcgcctggctgcgcaaggtcacgatccgggcggcatcgcgtagtgacaccgcacccgccacacaagctgcggcgatctcaccctgcgaatggccgatcaccgcatccggccgcacaccggccgcctgccacaccgcggccagggaaaccatcatcgcccaggaagcgggctggaccacatcaacccggtccaccaccgccggatcatccagaaccgtgaacagatcccagtccacgaactcgcgcaacgccgccgcacactcggccatccgctcggcgaacaccaccgacgaatcgcgcagtgcactgcccatccccagccactgccacccctgcccgggaaagacaaacacgatcctggggtcggtcaccgcggtgccggtgacggtgtcatctccaaggagtacggcgcggtgctcgaacaccgaccgtgtcaccgccagcgtcgatgccacagcccgtatatccgccccgggcgacgccgccaggtaggcgcgcagccggtcttcgtgttcggtcagggcgggctgggtcttggccgatatcaccagcggcagcacatccgaggccaccaccggcgtctcaacaggctgcgcctcctccgcgggctgagcggggggtgcgctctccaggatgacgtgggcgttggtgccgctgactccgaaggacgacacgcccgcccgacggggccggtcggtgccgggccagggctggttctccctcaccagctcaaccgcacccgccgcccagtccacgtgccgcgacggctcatccacgtgcagggtgcggggaaccgtgttgtgctgcagggccatgaccatcttgatgacacccgacacgcccgaggcggcctgagcatgaccgatgttcgacttcagcgaacccagcagcaggggccgttcccggtcctgaccgtaagtggcgatcagcgcctgggcctcgatcgggtcgcccagcgtcgtgcccgtgccgtgggcctcgaccacatccacctcgtgcgcggcgaggccggcgttactgagagcggcttggatcacccgctgctgcgaaggaccgttcggcgcggtcagaccgttggacgcgccgtcctggttgaccgccgagctacggaccaccgccaacacctgatggcccttggcctgggcgtcggaaagccgctctaccagcagcacaccaacgccttcagcccatcccgtgccgtccgcgctgtctgcgaacgccttgcaccggccatcggaggccagaccacgctggcgggagaattccacgaagctttgtggtgtggccatcacggtgacgccgccgaccagggccagggaacactctccctgccggagggcatacccggcctggtgcagtgccaccagtgatgacgagcaggctgtgtcgactgtgatggcggggccttcgaggccgaagaagtacgacacccggccggacaggacactggtcgcgctggcggtggccgcgaagccgccgaggtcagcaccggcaccgtagccaccgcgtacgcgcccatgaagacgccggtgtgtgccgcgcacggaaccgggctcgatcccggcccgctcgaaggcctcccaggacacctccatgatcagccgctgctgcgggtccatcgccagagcctcgcgtgggctgatgccgaagaatccggcgtcgaagctgcctgcgctgtcgaggaagccgccctctacgcagtacgacttgcccgacgcgtccgggtccggatcgaacaggctctccgcgtcccacccacggtcggcggggaaaccggaaatcgcatccgtacccgactccacaaggcgccacagatcctcaggcgacgacaccccgccgggcagacggcaggccatacccacgaccgccagcggctcgtcctgccccaccaccgacaccgacgggcgtaccggtgcagggttctcgccggtgaacagctcacccagccgggtggccaggatggccggggtggggtagtcgaacaccgtcgtgttgggcagccgcagccctgtggctttcgccaggctgttgcgcagttccaccgcggtcagcgaatcgatacccagatccttgaatgcggcggctgcggggatggtgctggcgtcagcgtgtcccaggaccagagcggcgctgtcacgcaccagcttcagcagtgcgtcttcccgctcggccggtgccagggccgccagccaccgcgctgacgagtcgctggtagaggcggcccgccgggcgacgggacgatgcaacgagcggaggagcgcggggacttccgcgtcccaaaccgggtccatcggtgcggcgaccagaatcgggttgccatggcgtgatgcggtgtcgaacagccgcatcccgtactcggcggtgatagtccgcaggccaccgcgccggatccggtcacggtccgtgtcggtcagttgcgtggtcaggccactggtgtcctcccacagacccaggccaccgcgaattgcgggcaggccctcggcgcggcgttcttcggcgagcgcgtccaggaacgcgtttgccgccgcgtagttaccttgccccccaccgcccatgacaccggcggcggaggagtacatgacgaaggcggccaggtcggtgttgcgggtgagttcgtgcagatgccaggcgccgtcggccttgggccgcagtaccgtgtcgagccgctgcgcggtcagggactcgacaacaccgtcatcgagtacgcccgcggtgtgaatcactgccgtcagggggtgctccggtgacacacccgccagcacctgggccagcgcggcacgatcggacacgtcacaggccgctgtctcgacccgggcgcccagttcgccgagttggttgatcagtgcctcgtccggggcgctgcgggacagcagcagcagatgacgcacgccgcgttcggccaccaggtgccgggcggcgatccccgccagcacacccgaaccaccggtgatcagaaccgtgccatccggatcccaaaccgcttcaggctcagacccactggcgttcacacgagccagtcgcggtgcctcgtaccggtcgccgctgacccgcagccgcggctcgtcgagcccgacggtggcggccaactggtccggggcgagcgtgtcgtcgtcgctctcgaccaggacgaaccggccggggtgttccgattgagccgatcgcatcaaccccgacaccccagcggcggccaaccgggtgccggtccgcacgaccagcgtgctgtcggtgaaacgttccccgccaagccaggtctggactgcctggaggacctgagcggtcagtacgcgggtctgttccagcgggttctcgctgctgtcggggagtgcggtgaagaccgccacctcgggtaccggcacatcagcgtccgacaccaggtcctcgaaccggccgaccgtcaggccggtttcctgaggggccgggatctccgcccaggtcagggtgagcaggtcgtcggtgctggtggcaggttcgtagacggggacggtgcgcagggtgagggagcggacggtcaggacggggaggcctgtgctgtcggtggcgtccacggacagggtgccgtcatcgtgtgagatgaggcggacgcgcagctcggcagggttgcgggcgtgcagggtcagcgcctgccacgcggcgggggtttcctcaccggcggtggtgagggcggcggtcaggagggcagggtgcagggcatatgtggtggcgtcgtgggtgctgtccagggcgacctcggcgaacacttcgttgcctcggcgccacaccccgcgcagtgacggtactccggtctcgaccgggaccgcaccggtcggcggccacgcctccccggcctgccagccggataccgttcccctggtggcgagggttgcggtggccaagcgtgtccagggctcgctgtcgctgtaacgggcgtggatactgagccggtggcgaccggcctcgtccggttcgctcacccaggtctgtacctggacggcgccatcgtcaggaagcagcagcaacgcttccacgttcaggtcctcaaccagaccgcagccggcctcgtccgccgctgccagcgccatctccacgaacaccgtcgcgggcagaaccgtctggtcccgcagccacagatcgccgctccgggaaacccgggcagtgaacaacaccccgctggcctcggccagccgcaccgccgaacccagcaacggatggccacccgcagtcgcccggtccgtgccctcgagccagtagcgctggtgctggaaggcgtatgtcggaaggtccagcacccgtgttgccggagcatcgcccaggagcgcgggccagtcgaccgtgacgccgttgacatacaggtgggccagggcgccgatcgcggcctggatttcgtggtcgccgtgcagcatcgcgacaccgtcgaccaggcgggccagtgaccggtcggcacccagctcgacgaacacggcgtcctcgtacgaggccacctgctcgccgaaccggaccgtgtcccggacctgccgcacccagtactcagcggtggtcacctgatcaccaacggccatggagacctgcggcgtccggtaggtcaggccttcggcgaccgcccggaactcctccagcatgggttccatacgggcggaatggaacgcgtggctggtcgccagccgcgtccacttccccagcccctccgcggcctgcagcacggcggcctcatcaccggagagaaccaccgacgacgggccgttgaccgcggcgatctccacaccctcacccagcacggcccgggcctcatcctccgagaccgggacagcgaccatcaccccacccgcgggcagagcctgcatcagacgagcccgcgccgacaccaaagtgcaggcatcctccaacgaccacaccccggacacatacgcagccgcaagctcacccaccgaatggccgatcaccgcgtccggtcgtacaccccacgattccagcagcccgaacagagccacctgcattgcgaacagggccggctgggcgtaaccggtctcgttcacctccagatcgggcacatcgagcaggtcccacacctgctgatggatccgcgcgaagacggggaacgcggcggccagttcctcacccatgccagcacgctgcgacccctgtcccgggaagacgaacaccgcccgagggtcagacacagcggtgccggtgacggtgtcatctcccagcagcacggcacggtgctcgaacaccgaccgtgtcatcgccagcgtcgatgccacagcccgcatatccaccccgggcgacgccgccagatacgcacgcaaccggccctcgtgctcagtcaaagccgactgggtcctggccgaaatcaccaacggcacccactccggtgcccgctcgatcaccgcgttgtccgcaggctgagtggggggtgcgctttccaggatgacgtgggcgttggtgccactgatcccgaaggacgacacgcctgcccggcgcgctcggcccatatccggccacggctggttctccgtcacgagctgcaccgcgcccgccgaccagtccacatgccgtgacggctcatcgacatgcaacgtgcgcggcaccagaccgtgttgcagggccatcaccatcttgatgacaccggacacacccgcagcggcctgcgtatgacccaggttcgacttcaccgaacccagcagcacaggctggtcacggtcctggccataggtagcgatcagcgcctgggcctcgatcgggtcacccagcgttgtgcccgtgccgtgcgcctcgaccacatccacctcagccgtgctcagacccgcgttgctgagagcggcccggatcacccgctgctgcgaaggaccattcggcgcggtcagaccgttcgacgcaccgtcctggttcaccgctgatccacgcaccaccgccaacacctggtgaccgttacggcgggcatcggagagtcgctctacgagcaggacaccgacaccttcagcccatcccgtgccgtccgcggcgtcggcgaacgctttgcagcggccgtcggaggccaggccgccctggcgggagaactccacgaaagtctgtggcgtggccatcacagtgacaccgccgaccagggccagcgaacactctccctgccggagggcataccccgcctgatgcaacgccaccaacgatgacgagcaggccgtgtcgactgtgaacgcgggaccctcgaggccgaagaagtacgacacccggccggacaggacactgaccgaactggcggtggccccgaagccgccgaggtcggcaccgatgccgtagccaccggggtacgcacccatgaaaacgccggtatcgctgccgcgtacggaaccgggctcgatcccggcccgctcgaacgcctcccaggacacctccagcaccagccgctgctgcggatccatcgccaacgcctcacgcggactgatcccgaagaatccggcatcaaagccagccgcggcatccaggaagccaccctcagcacggtgcgattttccagccatgtcgtacaggttctcgacgtcccagccacggtcggtggggaaaccggagaccgcatctgtacccgactccaggagacgccacagatcctcaggcgacgagactccaccgggtaggcggcaggccattcccacgatcgccagcggctcgtcctgcgccaccgccgacaccggcccgcgtaccggtacggggttctcgccggtgaacaactcgtccaaccgggcagccaaggcggccggggtggggtagtcgaacaccagcgtggcgggcagccgcagctccgtggccttcgccaggctgttgcgcagttccaccgcggtcagcgaattgatgcccagatccttgaacgccgtggttgccggaatcgtgctggtgtcggcgtgtcccagaaccgtcgcggcgccgtcagacaccagcttcagcagtgccttctcccgctcggccggtgccagggcggccagccaccgcgctccaccggcggcagcggcccgccgagcaatcgggcggtgcaacgaccgcagcaatgccgggacttccgcgtcccgtaccggctccatcggcgcggccaccagaaccggttcactgtggcgtgacgcgctgtcgaacagccccatcccgtgctcggcggagatggcccgcaggccaccgcgccggatccggtcacggtccgtgtcggtcagttgcgcggtcaggccactggcgtcctcccacagaccccaggccaccgcgagtgcgggcagaccctcagcgtgacgctgctcagccagcgcgtccaggaacgcattggccgccgcgtagttgccctgccccgcactaccgagcacaccggcggcggaggaatacatgacgaacgcggccaggtcggcatcccgggtgagctcgtgcaggttccacgcaccgtcggccttgggccgcagtaccgtctccagccgctgcacggtcaaagactccacaacaccgtcatccaccacgcccgcggtgtgaatcacggccgtcaggggatgctccggcgagacacccgccagcacctgcgtcagcgcggcaggatcggacacgtcacaggccgctgtctcgacccgggcccccagttcaccaagctcgccgatcagcgcctcatccggggcgctgcgggacagcagcaggagatgacgcacgccgcgttcggtcaccaggtgccgggcggcgatccccgccagcacacctgaaccgcccgtgatcaggaccgtgccatccggatcccacgtcctttcaggctcaggctcttcggcatgtgtgcgggtcagccgtggtacttcgtaccggccgtcgctgacccgcagccgcggctcatccagtccgaccgccgccgccagctgatcctgggtgagggcgtcgtcgctttcgaccaggacgaaccggccggggtgttcggactgggccgagcgcatcaaccccgacaccccagcagcggccaacccggtgccggtccgcaccaccagcgtgctgtcgctgaagcgctccccgccaagccactcctggagtgtgtggaggacctgagcggtcagctttcgtgtttgctccagcggatcgtcgctgtcggggagtgcggtgaagaccgccacctcgggtaccggcacatcgccgtccgccgccaggtcttcaaacgcacccaccgtcaggccggtctgctggggggtggggattcctgcccaggtcagggtgagcaggtcgtcggtgctggtggccggttcgtatacggggacggtgcgcagggtgagcgagcgggcggtcaggacggggaggcctgtgctgtcggtggcctctgccgacagggtgccgtcatcgtgtgaggtgaggcggacgcgcagctcgccgggattgccggcgtgcagggtcaggccctgccacacggcgggagtctcctcgcctacggtggtgagcgcggcggtcatcaggccgggatgacgcacaaacctggtggcatcatgggcatcgtccagggccacctcggtgaagatgtcgctgcccaggcgccacaccgcccgcagtgagggtgccgatgtcccgaccgggaccggaccggccggtggccacaccccaccggcctgccagccgaccgcggcagcggccacacccgtagtggtggccagggttgcggtggccaagcaggtccagggctcgccgtcaccgtaacgggcgtggacactgagccggcgccgaccgccctcatccggttcgcccacccaggtctgtacctcgacggcgccatcatcgggaagcagcagcaacgcttccacactcagatcctcaaccagaccgcagccgacctcgtccgccgctgccagcgccatctccacgaacaccgtcgcgggcagaaccgtctggtcccgcagccacagatcaccgctccgggaaacccgggcagtgaacaacaccccactggcctcggccagccgcaccaccgaacccagcaacggatgaccacccgcagtcgcccggtccgtgccctcaagccagtaccgctggtgctggaaggcgtacgtcggaagatccagcacccgggttaccgggacatcacccagcaccgcggaccactcgacactcacgccgttcacgtacaggtgagccagggcaccgacagcggcctgcgcctcatggtcaccgtgcagcatcgcgacaccgtcgaccaggcgggccagtgaccggtcggcacccagctcgacgaacacggcgtcctcgtacgaggccacctgctcgccgaaccggaccgtgtcccggacctgccgcacccagtactcagcggtggtcacctgatcaccaacggccatggagacctgcggcgtccggtaggtcaggccttcggcgaccgcccggaactcctccagcatgggttccatacgggcggaatggaacgcgtggctggtcgccagccgcgtccacttccccagcccctccgcggcctgcagcacggcggcctcatcaccggagagaaccaccgacgacgggccgttgaccgcggcgatctccacaccctcacccagcacggcccgggcctcatcctccgagaccgggacagcgaccatcaccccacccgcgggcagagcctgcatcagacgagcccgcgccgacaccaaagtgcaggcatcctccaacgaccacaccccggacacatacgcagccgcaagctcacccaccgaatggccgatcaccgcgtccggccgtacaccccacgattccagcaacccgaacagagccacctgcaaagcgaacagggccggctgggcatagccggtctcattcacatcgagatcgggcacatccagcagatcccacacctgctgatggatccgcgcgaagacgggaaacgcggcggccagttcctcacccataccagcacgctgcgacccctgacccgggaagacgaacaccacccgcggatcagacaccgcggtaccggagacagtgccgtcacccagcagcaccccacggtgttcgaacatcgaccgtgtcatcgccagtgttgacgcgacagcccgcatatccaccccgggcgacgccgccagatacgcgcgcagccggtcctcgtgtgcgttcagggccggtagcgtcttggcggaaatcaccagaggcaccggctccgagcccatcaccggcgcttctacgggctgggcggcgtcttcagcctgcgtggggggtgcgctctccaggatgacgtgggcattagtgccactgactccaaaggaggacacgcctgcccggcgcggccggccaatctccggccacggctggttttccgtcaccagctcaaccgcacccgccgtccagtccacatgccgcgacggctcatccacatgcaacgtacgcggcaccaaagcatgccgcagggccatcaccatcttgatgacacccgatacgccagcggcggcctgggtatgaccgatgtttgatttcagcgatccgagcagcaggggctgttcacggtcctggccgtaggtggcgatcacggcttgggcttcgatcgggtcgcccagcgtcgtacccgtgccgtggccctcgaccacgtccacctcggctgtggtcaaaccggcgttgctgagcgcggtctggatcactcgctgctgggaggggccgttcggcgcggtcaggccgttggacgcgccgtcctggttgaccgccgaactgcggaccaccgccagcacctggtgacccttggcctcagcgtccgacaaacgctccaccagcagcacaccgatgccctcggagaatccggcaccgtccgcactgtccgcgaaggctttgctgcggccgtcggtggccaggccacgctgccgggcgaattcggtgaagacgtccggcgtggccatcacggtgacaccgccgaccagggccagggaacattccccctgccgcagggcgtaccccgcctgatgcaacgccaccagcgacgaagaacatgcggtgtccaccgtgatggcggggccttcgaggccgaagaagtacgacacccggccggagagcacgctgggaccggatgtggtgccataaccctcaaggtcagcaccggcaccggcgccgtagccgcctgggtaagcgcctatgaagacgccggtgtcgctgccgcgaagggaaccgggctcgatcccggcccgttcgaacgcctcccaggacacctccaggaccagtcgctgctgtggatccatcgccaacgcctcacgcgggctgatcccgaagaacgaggcgtcgaaaccgcctgcggagtccaggaagccaccctgcacgcagtacgacttcccggacgcgtccggatcagggtcgtacaggttctcgacgtcccagccacggtcggcggggaagtcggaaatcgcgtccgtacccgactcgaccaagcgccacagatcctccggcgacgacaccccacccggcagacggcacgccatacccacaatcgccaacggctcggtgttggcggcggcaagtgcttccagtttggcgcgggtggtgtgcaactccgcagtcgcccagcgaagatattcgaccactttgtcttgctcaggca

SEQ ID NO: 160 - DNA, 38 bp, Artificial Sequence
  Primer
ctccaccgctgatgacatatgtcgatcatagcacgatc

SEQ ID NO: 161 - DNA, 38 bp, Artificial Sequence
  Primer
gatcgtgctatgatcgacatatgtcatcagcggtggag

SEQ ID NO: 162 - DNA, 36 bp, Artificial Sequence
  Primer
gtcgattggctgagcactagttcatgagcggagaac

SEQ ID NO: 163 - DNA, 36 bp, Artificial Sequence
  Primer
gttctccgctcatgaactagtgctcagccaatcgac

SEQ ID NO: 164 - DNA, 1679 bp, Artificial Sequence
  Primer
tgtgcagctccatcggtaccttcaaaaggtcatccaccggatcaattcccctgctcgcgcaggctgggtgccaagctctcgggtaacatcaaggcccgatccttggagcccttgccctcccgcacgatgatcgtgccgtgatcgaaatccagatccttgacccgcagttgcaaaccctcactgatccgcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactaagcacataattgctcacagccaaactatcagggcggccgctgctggggc

SEQ ID NO: 165 - DNA, 37 bp, Artificial Sequence
  Primer
ggtacccatatgatgagggaagcggtgatcgccgaag

SEQ ID NO: 166 - DNA, 35 bp, Artificial Sequence
  Primer
gcggccgcactagtttatttgccgactaccttggt

SEQ ID NO: 167 - DNA, 27 bp, Artificial Sequence
  Primer
ggccagtgccaagctccgagcgaccgg

SEQ ID NO: 168 - DNA, 27 bp, Artificial Sequence
  Primer
acatgattacgaattgcggtattgggc

SEQ ID NO: 169 - DNA, 283 bp, Artificial Sequence
  Primer
gacggccagtgaattcgctagcgactcctgttgatagatccagtaatgacctcagaactccatctggatttgttcagaacgctcggttgccgccgggcgttttttattggtgagaatatactagtgttctagaccaggcatcaaataaaacgaaaggctcagtcgaaagactgggcctttcgttttatctgttgtttgtcggtgaacgctctctactagagtcacactggctcaccttcgggtgggcctttctgcgtagatctttataagcttggcgtaatca

SEQ ID NO: 170 - DNA, 33 bp, Artificial Sequence
  Primer
gtgagaatatactagtctagtcatgcgagtgtc

SEQ ID NO: 171 - DNA, 35 bp, Artificial Sequence
  Primer
tgatgcctggtctagagatctggtctagtttactg

SEQ ID NO: 172 - DNA, 4492 bp, Artificial Sequence
  Primer
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatcatatgctgcgcccggtcgagaccccgacccgcgagatcaagaagctggacggcctgtgggccttctccctggaccgcgagaactgcggcatcgaccagcgctggtgggagtccgccctgcaggagtcccgcgccatcgccgtcccgggctccttcaacgaccagttcgccgacgccgacatccgcaactacgccggcaacgtctggtaccagcgcgaggtcttcatcccgaagggctgggccggccagcgcatcgtcctgcgcttcgacgccgtcacccactacggcaaggtctgggtcaacaaccaggaggtcatggagcaccagggcggctacaccccgttcgaggccgacgtcaccccgtacgtcatcgccggcaagtccgtccgcatcaccgtctgcgtcaacaacgagctgaactggcagaccatcccgccgggcatggtcatcaccgacgagaacggcaagaagaagcagtcctacttccacgacttcttcaactacgccggcatccaccgctccgtcatgctgtacaccaccccgaacacctgggtcgacgacatcaccgtcgtcacccacgtcgcccaggactgcaaccacgcctccgtcgactggcaggtcgtcgccaacggcgacgtctccgtcgagctgcgcgacgccgaccagcaggtcgtcgccaccggccagggcacctccggcaccctgcaggtcgtcaacccgcacctgtggcagccgggcgagggctacctgtacgagctgtgcgtcaccgccaagtcccagaccgagtgcgacatctacccgctgcgcgtcggcatccgctccgtcgccgtcaagggcgagcagttcctgatcaaccacaagccgttctacttcaccggcttcggccgccacgaggacgccgacctgcgcggcaagggcttcgacaacgtcctgatggtccacgaccacgccctgatggactggatcggcgccaactcctaccgcacctcccactacccgtacgccgaggagatgctggactgggccgacgagcacggcatcgtcgtcatcgacgagaccgccgccgtcggcttcaacctgtccctgggcatcggcttcgaggccggcaacaagccgaaggagctgtactccgaggaggccgtcaacggcgagacccagcaggcccacctgcaggccatcaaggagctgatcgcccgcgacaagaaccacccgtccgtcgtcatgtggtccatcgccaacgagccggacacccgcccgcagggcgcccgcgagtacttcgccccgctggccgaggccacccgcaagctggacccgacccgcccgatcacctgcgtcaacgtcatgttctgcgacgcccacaccgacaccatctccgacctgttcgacgtcctgtgcctgaaccgctactacggctggtacgtccagtccggcgacctggagaccgccgagaaggtcctggagaaggagctgctggcctggcaggagaagctgcaccagccgatcatcatcaccgagtacggcgtcgacaccctggccggcctgcactccatgtacaccgacatgtggtccgaggagtaccagtgcgcctggctggacatgtaccaccgcgtcttcgaccgcgtctccgccgtcgtcggcgagcaggtctggaacttcgccgacttcgccacctcccagggcatcctgcgcgtcggcggcaacaagaagggcatcttcacccgcgaccgcaagccgaagtccgccgccttcctgctgcagaagcgctggaccggcatgaacttcggcgagaagccgcagcagggcggcaagcagtaaactagtatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 173 - DNA, 27 bp, Artificial Sequence
  Primer
ggtaggatccacataatgcagggttct

SEQ ID NO: 174 - DNA, 22 bp, Artificial Sequence
  Primer
cacaggatactcgaggatcccc

SEQ ID NO: 175 - DNA, 23 bp, Artificial Sequence
  Primer
ctcgagtatcctgtggcacgaga

SEQ ID NO: 176 - DNA, 22 bp, Artificial Sequence
  Primer
gtgctcatcttggagatgcggc

SEQ ID NO: 177 - DNA, 27 bp, Artificial Sequence
  Primer
ctccaagatgagcacaaaaaagaaacc

SEQ ID NO: 178 - DNA, 31 bp, Artificial Sequence
  Primer
tgagatctggtctaggccaaacgtctcttca

SEQ ID NO: 179 - DNA, 20 bp, Artificial Sequence
  Primer
gcagtacatgggcgtccagg

SEQ ID NO: 180 - DNA, 38 bp, Artificial Sequence
  Primer
tgagatctggtctagatcagctaattaagcttagtgat

SEQ ID NO: 181 - DNA, 24 bp, Artificial Sequence
  Primer
acgcccatgtactgctcggtctcc

SEQ ID NO: 182 - DNA, 32 bp, Artificial Sequence
  Primer
ggtaggatccacatatgatgctgatcgctcag

SEQ ID NO: 183 - DNA, 35 bp, Artificial Sequence
  Primer
agttaggctaactagttttttggccttgaaatcgt

SEQ ID NO: 184 - DNA, 21 bp, Artificial Sequence
  Primer
atgactagaccgagcgcagcg

SEQ ID NO: 185 - DNA, 24 bp, Artificial Sequence
  Primer
gctcggtctagtcatgcgagtgtc

SEQ ID NO: 186 - DNA, 27 bp, Artificial Sequence
  Primer
tgagatctggtctagacagatccggcg

SEQ ID NO: 187 - DNA, 39 bp, Artificial Sequence; identical to SEQ ID NO: 55
  Primer

SEQ ID NO: 188 - DNA, 33 bp, Artificial Sequence; identical to SEQ ID NO: 54
  Primer

SEQ ID NO: 189 - DNA, 40 bp, Artificial Sequence
  Primer
agttaggctaactagtctagtcaacacgcacggtgttaag

SEQ ID NO: 190 - DNA, 35 bp, Artificial Sequence
  Primer
tgagatctggtctagaatcagccaatcgactggcg

SEQ ID NO: 191 - DNA, 27 bp, Artificial Sequence
  Primer
tgagatctggtctagaggatccccggg

SEQ ID NO: 192 - DNA, 37 bp, Artificial Sequence
  Primer
gaggagcgaagcataatgagattcaacttattgggac

SEQ ID NO: 193 - DNA, 35 bp, Artificial Sequence; identical to SEQ ID NO: 183
  Primer

SEQ ID NO: 194 - DNA, 21 bp, Artificial Sequence
  Primer
atgactagaccgagcgcagcg

SEQ ID NO: 195 - DNA, 24 bp, Artificial Sequence
  Primer
gctcggtctagtcatgcgagtgtc

SEQ ID NO: 196 - DNA, 27 bp, Artificial Sequence
  Primer
tgagatctggtctagacagatccggcg

SEQ ID NO: 197 - DNA, 36 bp, Artificial Sequence; identical to SEQ ID NO: 61
  Primer

SEQ ID NO: 198 - DNA, 35 bp, Artificial Sequence; identical to SEQ ID NO: 60
  Primer

SEQ ID NO: 199 - DNA, 29 bp, Artificial Sequence
  Primer
ggtaggatccacatatgtatgagcacaaa

SEQ ID NO: 200 - DNA, 32 bp, Artificial Sequence
  Primer
gacagatccggcgcgccagagcgcccaatacg

SEQ ID NO: 201 - DNA, 1326 bp, Artificial Sequence
  Synthetic
ggtaggatccacataatgggcgtccaggtcgaaaccatctccccgggcgacggccgcaccttcccgaagcgcggccagacctgcgtcgtccactacaccggcatgctggaggacggcaagaagttcgactcctcccgcgaccgcaacaagccgttcaagttcatgctgggcaagcaggaggtcatccgcggctgggaggagggcgtcgcccagatgtccgtcggccagcgcgccaagctgaccatctccccggactacgcctacggcgccaccggccacccgggcatcatcccgccgcacgccaccctggtcttcgacgtcgagctgctgaagctggaggcggccgcatcgaattcccggggatcctcgagttgcttcgccaagggcaccaacgtcctgatggccgacggctccatcgagtgcatcgagaacatcgaggtcggcaacaaggtcatgggcaaggacggccgcccgcgcgaggtcatcaagctgccgcgcggccgcgagaccatgtactccgtcgtccagaagtcccagcaccgcgcccacaagtccgactcctcccgcgaggtcccggagctgctgaagttcacctgcaacgccacccacgagctggtcgtccgcaccccgcgctccgtccgccgcctgtcccgcaccatcaagggcgtcgagtacttcgaggtcatcaccttcgagatgggccagaagaaggccccggacggccgcatcgtcgagctggtcaaggaggtctccaagtcctacccgatctccgagggcccggagcgcgccaacgagctggtcgagtcctaccgcaaggcctccaacaaggcctacttcgagtggaccatcgaggcccgcgacctgtccctgctgggctcccacgtccgcaaggccacctaccagacctacgccccgatcctgtacatgtccaagggcgaggagctgttcaccggcgtcgtcccgatcctggtcgagctggacggcgacgtcaacggccagaagttctccgtctccggcgagggcgagggcgacgccacctacggcaagctgaccctgaagttcatctgcaccaccggcaagctgccggtcccgtggccgaccctggtcaccaccttctcctacggcgtccagtgcttctcccgctacccggaccacatgaagcagcacgacttcttcaagtccgccatgccggagggctacgtccaggagcgcaccatcttctacaaggacgacggcaactacaagacccgcgccgaggtcaagttcgagggcgacaccctggtcaaccgcatcgagctgaagggcatctaactagaccagatctca

SEQ ID NO: 202 - DNA, 870 bp, Artificial Sequence
  Synthetic
ggtaggatccacataatcctgtggcacgagatgtggcacgagggcctggaggaggcctcccgcctgtacttcggcgagcgcaacgtcaagggcatgttcgaggtcctggagccgctgcacgccatgatggagcgcggcccgcagaccctgaaggaaacctccttcaaccaggcctacggccgcgacctgatggaggcccaggagtggtgccgcaagtacatgaagtccggcaacgtcaaggacctgctgcaggcctgggacctgtactaccacgtcttccgccgcatctccaaggcggccgcatcgaattcccggggatcctcgagtgacgtcctgctgaacgtcctgtccaagtgcgccggctccaagaagttccgcccggccccggccgccgccttcgcccgcgagtgccgcggcttctacttcgagctgcaggagctgaaggaggacgactactacggcatcaccctgtccgacgactccgaccaccagttcctgctggccaaccaggtcgtcgtccacaacgacttcaaggaggacggcaacatcctgggccacaagatggagtacaactacaactcccacaacgtctacatcatggccgacaagccgaagaacggcatcaaggtcaacttcaagatccgccacaacatcaaggacggctccgtccagctggccgaccactaccagcagaacaccccgatcggcgacggcccggtcctgctgccggacaaccactacctgtccacccagtccgccctgtccaaggacccgaacgagaagcgcgaccacatgatcctgctggagttcgtcaccgccgccggcatcacccacggcatggacgagctgtacaagctagaccagatctca

SEQ ID NO: 203 - protein, 419 aa, Streptomyces rapamycinicus
IAIVAMACRLPGGVSSPEGLWHLVESGTDAISGFPTDRGWDVEGLFDPDPDAAGKSYCVQGGFLDTAADFDAPFFGISPREALGMDPQQRLLLETTWEAIERAQIDPKSLRGRDVGVYVGGAAQGYGVGVDQQHDNGITGSSVSLLSGRVSYALGLEGPGVTVDTACSSSLVALHLASQALRQRECSLALVSGVSVMSSPAMFVEFSRQRGLSSDGRCKSFAASADGTIWSEGVGVLVVERLSDARRLGHRVLATVRGSAVNSDGASNGLTAPNGTSQQRVIRQALANAGLTASDVDVVEAHGTGTKLGDPIEAEAILATYGQERSAPAWLGSLKSNIGHAMAASGVLSVIKMVEAMAHGSLPRTLHVDAPSPHVDWTSGSVALLTEHQPWPDDTKLRRAGVSSFGLSGTNAHVVLEQY

SEQ ID NO: 204 - protein, 417 aa, Streptomyces rapamycinicus
AIVGMACRLPGGVSSPEDLWRLVESGTDAVSGFPTDRGWDVENLYDSDPEAAGKSYCVQGGFLDTAAGFDAGFFGISPREALAMDPQQRLLLEVSWEAFERAGIEPGSVRGSDTGVFIGAFPVGYGAGFDREGYGATSGPSVLSGRVSYVFGLEGPAITMDTACSSSLVALHLAAQALRNGECSMALAGGVTVMATPEVFTEFARQRGLASDGRCKAFADSADGAGFSEGAGLLLVERLSDARRNGHQVLAVVRGSAVNQDGASNGLTAPNGPSQQRVIRAALSNAGLSTADVDVVEAHGTGTTLGDPIEAQALLATYGQDREQPLLLGSLKSNIGHTQAASGVSGVIKMVMALRHGFVPRTLHVDEPSRHVDWAAGAVELVRENQPWPGTDRPRRAGVSSFGVSGTNAHVVLESAP

SEQ ID NO: 205 - protein, 417 aa, Streptomyces rapamycinicus
AIVGMACRLPGGVSSPEDLWRLVESGTDAVSGFPTDRGWDVEGLFDPDPDAAGKSYRAEGGFLDTAAGFDAGFFGISPREALAMDPQQRLLLEVSWEAFERAGIEPGSVRGSDTGVFIGAFPVGYGAGAAREGYGATAAPNVLSGRLSYFFGLEGPAITMDTACSSSLVALHLAAQALRNGECSMALAGGVTVMATPEVFTEFARQRGLASDGRCKAFADSADGAGFSEGAGLLLVERLSDARRNGHQVLAVVRGSAVNQDGASNGFTAPNGPAQQRVIRQALANAGLTTAEVDVVEAHGTGTTLGDPIEAQAVIATYGQDREQPLLLGTLKSNVGHTQAAAGVSGVIKMVMALQHSTVPRTLHVNEPSRHVDWSAGAVELVTENQSWPVTGRPRRAGVSAFGVSGTNAHVVLESAP

SEQ ID NO: 206 - protein, 414 aa, Streptomyces rapamycinicus; identical to SEQ ID NO: 37

SEQ ID NO: 207 - protein, 418 aa, Streptomyces rapamycinicus; identical to SEQ ID NO: 38

SEQ ID NO: 208 - protein, 417 aa, Streptomyces rapamycinicus
AVVGMACRLPGGVSSPEDLWRLVESGTDAISGFPADRGWDAESLFDPDPDASGKSYCVEGGFLDSAGSFDAGFFGISPREALAMDPQQRLIMEVSWEAFERAGIEPGSVRGTHRRLHGRVRGGYGAGADLGGFAATASATSVLSGRVSYFFGLEGPAITVDTACSSSLVALHQAGYALRQGECSLALVGGVTVMATPQSFVEFSRQRGLASDGRCKAFADSADGTGWAEGVGVLLVERLSDAQAKGHQVLAVVRSSAVNQDGASNGLTAPNGPSQQRVIQAALSNAGLAAHEVDVVEAHGTGTTLGDPIEAQALIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAP

SEQ ID NO: 209 - protein, 419 aa, Streptomyces rapamycinicus
AIVGMACRLPGGVSSPEDLWRLVESGTDAISDFPADRGWDVENLYDPDPDASGKSYCVQGGFLDSAGGFDASFFGISPREALAMDPQQRLVLEVSWEAFERAGIEPGSLRGSDTGVFIGAYPGGYGAGAGADLEGYGTTSGPSVLSGRVSYFFGLEGPAITVDTACSSSLVALHQAGYALRQGECSLALVGGVTVMATPDVFTEFARQRGLATDGRSKAFADSADGAGFSEGIGVLLVERLSDAEAKGHQVLAVVRSSAVNQDGASNGLTAPNGPSQQRVIQTALSNAGLTTAEVDVVEGHGTGTTLGDPIEAQAVIATYGQDREQPLLLGSLKSNIGHTQAAAGVSGVIKMVMALRHALVPRTLHVDEPSRHVDWTAGAVELVTENQPWPEIGRPRRAGVSSFGVSGTNAHVILESAP

SEQ ID NO: 210 - protein, 418 aa, Streptomyces rapamycinicus
AIVGMACRLPGGVSSPEDLWRLVESGTDAISGFPTDRGWDVDGLFDPDPDASGKSYCVQGGFLDTAAGFDASFFGISPREALAMDPQQRLVLEVSWEAFERAGIEPGSVRGSDTGVFMGGFPGGYGAGADLEGFGATAGAASVLSGRVSYFFGLEGPAITVDTACSSSLVALHQAGYALRQGECSLALVGGVTVMPTPQSFVEFSRQRGLSADGRCKAYADAADGTEWAEGVGVLLVERLSDAQAKGHQVLAVVRGSAVNQDGASNGLSAPNGPSQQRVIRAALSNAGLAPHEVDVVEAHGTGTTLGDPIEAQAVIATYGQDREQPVLLGSLKSNIGHAQAAAGVSGVIKMVMALRHGFVPRTLHVDEPSRHVDWSAGAVELVAENRSWPATGRPRRAGVSAFGVSGTNAHVILEGAP

SEQ ID NO: 211 - protein, 418 aa, Streptomyces rapamycinicus
AIVGMACRLPGGVSSPEDLWRLVESGTDAISGFPTDRGWDVENLYDPDPDAPGKSYSVQGGFLDAAAGFDASFFGISPREALAMDPQQRLMLEVSWEAFERAGIEPGSVRGSDTGVFIGAYPGGYGIGADLGGFGTTAGAASVLSGRVSYFFGLEGPAFTVDTACSSSLVALHQAGYALRQGECSLALVGGVTVMPTPQTFVEFSRQRGLSADGRCKAFADAADGTGWAEGVGVLLVERLSDAQANGHQILAVVRSSAVNQDGASNGLSAPNGPSQQRVIRAALSNAGLAPHEVDVVEAHGTGTTLGDPIEAQAVIATYGQGRGEPLLLGSLKSNVGHTQAAAGVSGVIKMVMALQHSMVPRTLHVDEPSRHVDWSAGAVELVAENQPWPETGRPRRAGVSSFGISGTNAHVILESAP

SEQ ID NO: 212 - protein, 417 aa, Streptomyces rapamycinicus
AIVGMACRLPGGVSSPEDLWRLVESGTDAISGFPTDRGWDVENLFDSDPDAAGKSYCVEGGFLATAANFDASFFGISPREALAMDPQQRLVLEVSWEAFERAGIEPGSVRGSDTGVFMGAFPGGYGIGADLEGYGATAGLNVLSGRLSYFFGLEGPAVTVDTACSSSLVALHQAGYALRQGECSLALIGGVTVMATPHTFVEFSRQRGLASDGRCKAFADSADGTGWSEGVGVLLVERLSDAQAKGHQVLAVVRSSAVNQDGASNGLSAPNGPSQQRVIRQALANAGLTTAEVDVVEAHGTGTTLGDPIEAQAVIATYGQDRDQPVLLGSVKSNVGHTQAAAGVSGVIKMVMALQHGLVPRTLHVDEPSRHVDWTDGAVELVTENQSWPEAGRPRRAGVSSFGVSGTNAHVILESAP

SEQ ID NO: 213 - protein, 418 aa, Streptomyces rapamycinicus
AIVGMACRLPGGVSSPEDLWRLVESGTDAISGFPADRGWDVENLYDPDPEAAGKSYCVQGGFLDSAGGFDASFFGISPREALAMDPQQRLVLEASWEAFERAGIEPGSLRGSDTGVFMGAYPGGYGVGADLGGFGATAGAVSVLSGRVSYFFGLEGPAVTVDTACSSSLVALHQAAYALRQGECSLALVGGVTVMATPQSFVEFSRQRGLASDGRCKAFADSADGTGWAEGAGVLLVERLSDAQRKGHQVLAVVRGSAVNQDGASNGLSAPNGPSQQRVIRAALSNAGLSTAEVDVVEAHGTGTTLGDPIEAQALLATYGQDREQPLLLGSVKSNLGHTQAAAGVSGVIKMVMALQHVLVPRTLHVDEPSRHVDWTDGAVALVTENQPWPDMGRPRRAGVSSFGISGTNAHVILESAP

SEQ ID NO: 214 - protein, 414 aa, Streptomyces rapamycinicus
AIVGMACRLPGGVSSPEDLWRLLESGTDAVSGFPTDRGWDVENLYDMAGKSHRAEGGFLDAAAGFDAGFFGISPREALAMDPQQRLVLEVSWEAFERAGIEPGSVRGSDTGVFMGAYPGGYGIGADLGGFGATASSVSVLSGRVSYFFGLEGPAFTVDTACSSSLVALHQAGYALRQGECSLALVGGVTVMATPQTFVEFSRQGGLASDGRCKAFADAADGTGWAEGVGVLLVERLSDARRNGHQVLAVVRGSAVNQDGASNGLTAPNGPSQQRVIRAALSNAGLSTAEVDVVEAHGTGTTLGDPIEAQALIATYGQDRDQPVLLGSVKSNLGHTQAAAGVSGVIKMVMALQHGLVPRTLHVDEPSRHVDWSAGAVQLVTENQPWPDMGRARRAGVSSFGISGTNAHVILESAP

SEQ ID NO: 215 - protein, 414 aa, Streptomyces rapamycinicus
AIVGMACRLPGGVSSPEDLWRLLESGTDAVSGFPTDRGWDVENLFGPAVGNSYRLQGGFLDAAAGFDASFFGISPREALAMDPQQRLVLEVSWEAFERAGIKPGSVRGTDTGVFMGAYPGGYGIGADLGGFGTTAGAVSVLSGRVSYFFGFEGPAFTVDTACSSSLVALHQAGYALRQGECSLALVGGVTVMATPQTFVEFARQGGLAGDGRSKAFADSADGAGFSEGVGVLLVERLSDARRNGHQVLAVVRGSAVNQDGASNGLTAPNGPSQQRVIRAALSNAGLSTAEVDVVEAHGTGTTLGDPIEAQALMATYGQDREQPLLLGSVKSNLGHTQAAAGVSGVIKMVMALQRGFVPRTLHVDEPSRHVDWSAGAVQLVTENQPWPGTDRPRRAGVSSFGISGTNAHVILESA

SEQ ID NO: 216 - protein, 415 aa, Streptomyces rapamycinicus
AIVGMACRLPGGVSSPEDLWRLLESGTDAVSGFPTDRGWDVENLFGPAAGDSYRLQGGFLDAAAGFDASFFGISPREALAMDPQQRLVLEVSWEAFERAGIEPGSVRGTDTGVFMGAYPGGYGIGADLGGFGATASAVSVLSGRVSYFFGLEGPAITVDTACSSSLVALHQAGYALRQGECSLALVGGVTVMATPQTFVEFARQGGLAGDGRSKAFADSADGAGFSEGVGVLLVERLSDAQAKGHQVLAMLRSSAVNQDGASNGLTAPNGPSQQRVIQAALSNAGLAAHEVDVVEAHGTGTTLGDPIEAQALLATYGQDREQPLLLGSVKSNLGHTQAAAGVSGVIKMVMALQRGFVPRTLHVDEPSRHVDWSAGAVALVTENQPWPDMGRARRAGVSSFGISGTNAHVILESAP

SEQ ID NO: 217 - protein, 273 aa, Streptomyces rapamycinicus
VFPGQGWQWLGMGSALRTSSMVFAERMAECAAALSEFVDWDLFAVLDDPAVVARVDVVQPASWAVMVSLAAVWQAAGVRPDAVVGHSQGEIAAACVAGAVSLRDAARVVTLRSQVIARGLAGRGAMASVALPAQDVELVDGAWVAARNGPASTVVAGAPEAVDRVLAVHEARGVRVRRIAVDYASHTPHVELIRDELLGVIAGVDSRAPVVPWLSTVDGTWVEGPLDAEYWYRNLREPVGFEPAAGQLQAQGDTVFVEVSASPVLLQAMDDDV

SEQ ID NO: 218 - protein, 273 aa, Streptomyces rapamycinicus
VFPGQGWQWLGMGSALRGSSVVFAERMAECAAALSEFVDWDLFAVLDDPAVVDRVDVVQPASWAVMVSLAAVWQADGVRPDAVIGHSQGEIAAACVAGAVSLRDAARSVTLRSQAIARGLAGRGAMASVALPAHEIELVDGAWIAAHNGPASTVVAGAPEAVDRVLAVHEARGVRVRRIAVDYASHTPHVELIRDELLDITAGIGSQAPVVPWLSTVDGTWVEGPLDVEYWYRNLREPVGFDSAVGQLRAEGDTVFVEVSASPVLLQAMDDDV

SEQ ID NO: 219 - protein, 272 aa, Streptomyces rapamycinicus
VFPGQGWQWLGMGSALRDSSVVFAERMAECAAALSEFVDWDLFAVLDDPAVVDRVDVVQPASWAVMVSLAAVWQAAGVRPDAVIGHSQGEIAAACVAGAVSMRDAARIVTLRSQAIARGLAGRGAMASVALPAQDVELVDGAWIAAHNGPASTVIAGTPEAVDHVLTALRQRGAGAADHVDYASHTPHVELIRDELLDITSDSSSQDPLVPWLSTVDGTWVDSPLDGEYWYRNLREPVGFHPAVSQLQAQGDTVFVEVSASPVLMQAMDDDV

SEQ ID NO: 220 - protein, 273 aa, Streptomyces rapamycinicus
VFPGQGWQWLGMGSALRDSSVVFAERMAECAAALSEFVDWDLFAVLDDPAVVDRVDVVQPASWAVMVSLAAVWQAAGVRPDAVIGHSQGEIAAACVAGAVSLRDAARIVTLRSQAIARGLAGRAAMASVALPAHEIELVDGAWIAAHNGPASTVIAGTPEAVDHVLTAHEARGVRVRRITVDYASHTPHVELIRDELLGITAGIGSQPPVVPWLSTVDGSWVDSPLDGEYWYRNLREPVGFHPAVSQLQAQGDAVFVEVSASPVLLQAMDDDV

SEQ ID NO: 221 - protein, 273 aa, Streptomyces rapamycinicus; identical to SEQ ID NO: 86

SEQ ID NO: 222 - protein, 272 aa, Streptomyces rapamycinicus
VFPGQGWQWLGMGSALRDSSVVFAERMAECAAALSEFVDWDLTVLDDPAVVDRVDVVQPASWAVMVSLAAVWQAAGVRPDAVIGHSQGEIAAACVAGAVSLRDAARIVTLRSQAIARGLAGRGAMASVALPAQDVELVDGAWIAAHNGPASTVIAGTPEAVDHVLTAHEARGVRVRRITVDYASHTPHVELIRDELLDITSDSSSQAPLVPWLSTVDGSWVDSPLDGEYWYRNLREPVGFHPAVGQLQAQGDTVFVEVSASPVLLQAMDDDV

SEQ ID NO: 223 - protein, 273 aa, Streptomyces rapamycinicus
VFPGQGWQWLGMGSALRDSSVVFAERMAECAAALREFVDWDLFTVLDDPAVVDRVDVVQPASWAMMVSLAAVWQAAGVRPDAVIGHSQGEIAAACVAGAVSLRDAARIVTLRSQAIARGLAGRGAMASVALPAQDVELVDGAWIAAHNGPASTVIAGTPEAVDHVLTAHEAQGVRVRRITVDYASHTPHVELIRDELLDITSDSSSQTPLVPWLSTVDGTWVDSPLDGEYWYRNLREPVGFHPAVSQLQAQGDTVFVEVSASPVLLQAMDDDV

SEQ ID NO: 224 - protein, 292 aa, Streptomyces rapamycinicus
LFDGQGTQRLGMGKELYDSYPAFARAWDTVSAGFDKHLDHSLTDVCFGEGGSTTAGLVDDTLYAQAGIFAMEAALFGLLEDWGVRPDFVAGHSIGEATAAYASGMLSLENVTTLIVARGRALRTTPPGAMVALRAGEEEVREFLSRTGAALDLAAVNSPEAVVVSGEPEPVADFEAAWTASGREARKLKVRHAFHSRHVEAVLDEFRTALESLKFRAPALPVVSTVTGRLIDQDEMGTPEYWLRQVRRPVRFQDAVRELAEQGVGTFVEVGPSGALASAGVECLGGDASFHA

SEQ ID NO: 225 - protein, 256 aa, Streptomyces rapamycinicus
VFPGQGSQRAGMGEELAAAFPVFARIHQQVWGLLDVPDLEVNETGYAQPALFALQVALFGLLESWGVRPDAVVGHSVGELAAGYVSGLWSLEDACTLVSARARLMQALPPGGVMVAVPVSEDEARAVLGEGVEIAAVNGPSSVVLSGDETAVLQAAAALGKSTRLATSHAFHSARMEPMLEEFRTVAERLTYQTPRLAMAAGDRVTTAEYWVRQVRDTVRFGEQVASYEDAVFIELGADRSLARLVDGVAMLHTDH

SEQ ID NO: 226 - protein, 255 aa, Streptomyces rapamycinicus
VFPGQGSQRAGMGAELAAAFPVFARIHQQVWDLLDVPDLEVNETGYAQPALFALQVALFGLLESWGVRPDAVIGHSVGELAAAYVSGLWSLEDACTLVSARARLMQALPAGGVMVAVPVSEDEARAVLGEGVEIAAVNGPSSVVLSGDEAAVLQAAEGLGKWTRLATSHAFHSARMEPMLEEFRAVAQGLTYHAPGVVMAAGDRVMTAEYWVRQVRDTVRFGEQVASYEDAVFVELGADRSLARLVDGVAMLHGD

SEQ ID NO: 227 - protein, 260 aa, Streptomyces rapamycinicus; identical to SEQ ID NO: 85

SEQ ID NO: 228 - protein, 260 aa, Streptomyces rapamycinicus
VFPGQGSQRAGMGEELAAAFPVFARIHQQVWDLLDVPDLEVNETGYAQPALFALQVALFGLLESWGVRPDAVVGHSVGELAAGYVSGLWSLEDACTLVSARARLMQALPAGGVMVAVPVSEDEARAVLGEGVEIAAVNGPSSVVLSGDEAAVLQAAEGLGKWTRLATSHAFHSARMEPMLEEFRAVAEGLTYRTPQVSMAAGDQLTTTEYWVRQVRDTVRFGEQVASYEDAVFVELGADRSLARLVDGVAMLHGDHEAQA

SEQ ID NO: 229 - protein, 256 aa, Streptomyces rapamycinicus
VFPGQGSQRAGMGEELAAAFPVFARIHQQVWDLLDVPDLDVNETGYAQPALFALQVALFGLLESWGVRPDAVIGHSVGELAAAYVSGVWSLEDACTLVSARARLMQALPAGGVMVAVPVSEDEARAVLGEGVEIAAVNGPSSVVLSGDEAAVLQAAEGLGKWTRLATSHAFHSARMEPMLEEFRAVAEGLTYRTPQVSMAVGDQVTTAEYWVRQVRDTVRFGEQVASYEDAVFVELGADRSLARLVDGVAMLHGDH

SEQ ID NO: 230 - protein, 255 aa, Streptomyces rapamycinicus
VFPGQGSQRAGMGEELAAAFPVFARIHQQVWDLLDVPDLEVNETGYAQPALFAMQVALFGLLESWGVRPDAVIGHSVGELAAAYVSGVWSLEDACTLVSARARLMQALPAGGVMVAVPVSEDEARAVLGEGVEIAAVNGPSSVVLSGDEAAVLQAAEGLGKWTRLATSHAFHSARMEPMLEEFRAVAEGLTYRTPQVSMAVGDQVTTAEYWVRQVRDTVRFGEQVASYEDAVFVELGADRSLARLVDGVAMLHGD

SEQ ID NO: 231 - protein, 349 aa, Streptomyces rapamycinicus
GTILITGGSGVLAGILARHLAAEHGARHLLLLSRTTPDQALIKELAELGAHVDTATCDVSDRAGLARVLAGVSPEHPLTAVIHTAGALDDGVVESLTTQQLDTVLRPKADGAWHLHELTQNTDLAAFVMYSSAAGVIGGAGQGNYAAANAFLDALAEQRRAEGLPALALAWGLWDDTSGLTSGLTDTDHDRIRRSGMRTITAEHGMRLFDGASRHGEPVLFAAAMSPLRGDVEVPALLRGLQTVKRPQSRTAARNEVGSQPLSARLTGRTSVEQHRIMLELVLERRSVLGHSSADAIATDTSFKDLGMDSLTAIELRNRLVAETGLQLPATMVFDYPTANALAAHLLGK

SEQ ID NO: 232 - protein, 327 aa, Streptomyces rapamycinicus
GTVLITGGSGVLAGALARHLVTERGVRHLLLLSRTTADEGLLNELGELGARVETADCDVSDRAGLARVLAGVSPEHPLTAVIQTAGALDDGVLETLTAQRLDTVLRPKADGAWHLHELTRNTGLAAFVMYSSAAGVMGNPGQGNLAAATAFLDALADQRRAEGLPALALAWGSSEETSDLIGLRTISAERGMRLFDSASHRGEPLLMAASLDPARAAEVPALLRSLRRPVARRAASADGGVQWLAALAPAEREKALLKVVCDSAAVVLGHADARTIPVTGAFKDLGVDSLTAVELRNSLVKATGLRLPATMVFDYPTPTALAARLDE

SEQ ID NO: 233 - protein, 341 aa, Streptomyces rapamycinicus; identical to SEQ ID NO: 40

SEQ ID NO: 234 - protein, 340 aa, Streptomyces rapamycinicus
GTVLITGGSGVLAGIVARHLVAERGVRHLLLLSRGTPDRALLSELAELGAAVDTAACDVSDRAELARVLARVSPEHPLTAVIHTAGVVDDGVVESLSAQRLETVFRPKADGAWHLHELTRDADLAAFVMYSSAAGVMAGAGQGNYAAANAFLDALAEERRAEGLPALAVAWGLWEDASGLTAQLTDTDRDRIRRGGLRAISAEHGMRLFDNASRHSEPVLVAAPMEPVRDAEVPALLRSLHRPNVRRAALAGGAQWLAALAPEERAKALLKVVRDTAATVLGHADARTIPVTGAFRDLGIDSLTAVELRNGLAKVTGLRLPATLVFDYPTPAVLAARLGE

SEQ ID NO: 235 - protein, 343 aa, Streptomyces rapamycinicus
GTVLITGGSGVLAGIAARHLVAERGVRHLLLLSRSAPDEALISELAELGAAVVDTAVCDVSDRAGLARVLAGVSPDHPLTAVIHTAGVLDDGVVESLTARRLDTVLRPKADGAWNLHELTRDIDLAAFVMYSSAAGVLGSAGQGNYAVANAFVDALAEQRRAEGLPALALAWGLWEDASGLTAKLTGTDHDRIRRSGLRTITAERGMRLFDIASRQGEPVLVATPMEPVREVEVPALLRLLHRPVARRAASTGDSSAQWLVGLAPEERAKALLKVVRDSAATVLGHADARSIPATGAFKDLGVDSLTAVELRNSLTKATGLRLPATMVFDYPTPADLAARLGD

SEQ ID NO: 236 - protein, 340 aa, Streptomyces rapamycinicus
GTVLITGGSGVLAGIAARHLVAERGVRHLLLLSRSAPDGALISELGELGAQVATAVCDVSDRPGLVRVLADVSPEHPLTAVIHTAGVVDDGVVESLTAQRLDTVLRPKADGAWHLHELTRDADLAAFVMYSSAAGVFGSAGQGNYAVANAFLDALAEQRRAEGLPALALAWGLWEGTSGLTANLTDTDHDRIRRSGMRAISAEHGMRLFDGASRRRDPVLVAAAMEPVREAEVPAMLRSLHRPVARRAASGGAVRCLAALAPEERAKALVKVVCDSAATVLGHADVDSIPVTAAFRDLGVDSLTAVELRNSLTKATGLRLPATLVFDYPTPGALAARLEE

SEQ ID NO: 237 - protein, 342 aa, Streptomyces rapamycinicus
GTILITGGSGVLAGILARHLAAEHGARHLLLLSRTTPDQALIKELAELGAHVDTATCDVSDRAGLARVLAGVSPEHPLTAVIHTAGALDDGVVESLTTQQLDTVLRPKADGAWHLHELTQNTDLAAFVMYSSAAGVLGSAGQGNYAAANAFVDALAEQRRGEGLPALAVAWGLWEDTSGLTAKMTDTDRDRIRRGGLRAISAGRGMGLLDAASRHGEPVLLAASMEPVRDVEVPALLRLLHRPVARRAASTGDSSVQWLARLAPVEREKALLKLVCDGAATVLGHADASTIPATGAFRDLGVDSLTAVELRNGLAKATGLRLPATLVFDYPTPAALAARLEE

SEQ ID NO: 238 - protein, 341 aa, Streptomyces rapamycinicus
GTVLVTGGSGVLAGIAARHLVAEQGVRHLLLLSRSTPDDALINELGELGARVDTAICDVSDRAGLARILAGVSPEHPLTAVIHTAGALDDGVVESLTAQQLETVLRPKADGAWHLHELTRDADLAAFVMYSSAAGVLGSGGQGNYAAANAFLDALAEQRRGEGLPALAVAWGLWEDASGLTAEMTDTDRDRIRRGGLRAISAGHGMGLLDAASRHGEPVLLAAAMEPVREAEVPALLRLLHRPVARRAASTGGSSVQWLARLAPVEREKALLKLVCDGAATVLGHADASTIPATAAFKDLGIDSLTAVELRNSLTKATGLRLPATLVFDYPTPTALAARLG

SEQ ID NO: 239 - protein, 342 aa, Streptomyces rapamycinicus
GTVLITGGSGVLAGIAARHLVAERGVRHLLLLSRSAPDEALINQLGELGARVETAACDVSDRAALAQVLAGVSPEHPLTAVIHTAGVLDDGVVESLTAQRLDTVLRPKADGAWHLHELTRNTDLAAFVMYSSAAGVMGGGGQGNYAAANAFLDALAEERRAEGLPAIRGGLGLWEDTSGLTTQLTDTDRDRIRRGGLRTITAEYGMRLFDTASRHGNPILVAAPMDPVWDAEVPALLRSLHRPVARRAASTSDSSARWLAALAPAEREDALLKLVRDSAALVLGHADASTIPAAAAFKDLGIDSLTAVELRNSLAKATGLRLPNTTVFDYPTPAILATRLGE

SEQ ID NO: 240 - protein, 339 aa, Streptomyces rapamycinicus; identical to SEQ ID NO: 39

SEQ ID NO: 241 - protein, 340 aa, Streptomyces rapamycinicus
GTVLITGGSGVLAGIAARHLVTERGVRHLLLLSRSAPDEALIGELGELGARVETAACDVSDPAALTQVLAGVSPEHPLTAVIHTAGVVDDGVVESLTVQRLETVLRPKADGAWNLHELTRDADLAAFVMYSSAAGVLGSAGQGNYAAANAFLDALAEQRHAEGLPALAVAWGLWEDASGLTAQLTDTDRDRIRRGGLRAISAEHGMGLFDSASRHSEPVLVAAPMEPVRDAEVPALLRSLHRPIARRAAAAGGARWLAALAPAEREKALLKLVSDGAATVLGHADTSTIPATTAFKDLGINSLTAVELRNSLAKATELRLPATLVFDYPTPAALAARLDE

SEQ ID NO: 242 - protein, 342 aa, Streptomyces rapamycinicus; identical to SEQ ID NO: 41

SEQ ID NO: 243 - protein, 340 aa, Streptomyces rapamycinicus
GTVLITGGSGVLAGIAVRHLVTERGVRHLLLLSRSAPDEALINQLGELGARVETAACDVSDRAALAQVLAGVSPEHPLTAVIHTAGVLDDGVVESLTAQRLDAVLRPKADGAWNLHELTRDADLAAFVMYSSAAGVLGSGGQGNYAAANAFLDALAEQRHAEGLPALAVAWGLWEDASGLTAQLTDTDRDRIRRGGLRAISAEHGMGLFDSASRHSEPVLVAAPMEPVRDAEVPALLRSLHRPVARRAAAAGGARWLAALAPAEREKALLKLVSDGAATVLGHADTSTIPATTAFKDLGIDSLTAVELRNSLAKATELRLPATLVFDYPTPTALAARLDE

SEQ ID NO: 244 - DNA, 64 bp, Artificial Sequence
  Synthetic
tgaggtggatgtggtcgaggcgcacggcacgggcacaacgctgggtgacccgatcgaggcccag

SEQ ID NO: 245 - DNA, 64 bp, Artificial Sequence
  Synthetic
cgaggtggatgtggtcgaggcccacggcacgggtacgacgctgggcgacccgatcgaggcccag

SEQ ID NO: 246 - DNA, 64 bp, Artificial Sequence
  Synthetic
cgaggtggatgtggtcgaggcccacggcacgggcacgacgctgggcgacccgatcgaggcccag

SEQ ID NO: 247 - DNA, 64 bp, Artificial Sequence
  Synthetic
cgaggtggatgtggtcgaggcacacggcacgggtacgacgctgggtgacccgatcgaggcccag

SEQ ID NO: 248 - DNA, 64 bp, Artificial Sequence
  Synthetic
cgaggtggatgtggtcgaggcgcacggcacgggtacgacgctgggtgacccgatcgaggcccag

SEQ ID NO: 249 - DNA, 64 bp, Artificial Sequence
  Synthetic
cgaagtggacgtcgtcgaggcgcatggcacgggcacgacgcttggtgacccgatagaagcccaa

SEQ ID NO: 250 - DNA, 64 bp, Artificial Sequence; identical to SEQ ID NO: 249
  Synthetic

SEQ ID NO: 251 - DNA, 64 bp, Artificial Sequence; identical to SEQ ID NO: 245
  Synthetic

SEQ ID NO: 252 - DNA, 64 bp, Artificial Sequence
  Synthetic
cgaggtcgatgtggtggaggcacacggtaccggtactaccctgggtgatcctatcgaggcacag

SEQ ID NO: 253 - DNA, 64 bp, Artificial Sequence
  Synthetic
tgaggtcgatgtggtggaggcacacggtaccggtactaccctgggtgatcctatcgaggcacag

SEQ ID NO: 254 - protein, 180 aa, Artificial Sequence
  synthetic
GTGTTLGDPIEAQAVIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAPPAQPAEEAQPVETPVVASDVLPLVISAKTQPALTEHEDRLRAYLAASPGADIRAVASTLAVT

SEQ ID NO: 255 - protein, 180 aa, Artificial Sequence
  synthetic
GTGTTLGDPIEAQAVIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAPPAQPAEEAQPVETPVVASDVLPLVISAKTQPALTEHEDRLRAYLAASPGADTRAVASTLAVT

SEQ ID NO: 256 - protein, 180 aa, Artificial Sequence
  synthetic
GTGTTLGDPIEAQALIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAPPAQPAEEAQPVETPVVASDVLPLVISAKTQPALTEHEDRLRAYLAASPGADIRAVASTLAVT

SEQ ID NO: 257 - protein, 103 aa, Artificial Sequence
  synthetic
TSGLTSGLTDTDHDRIRRSGMRTITAEHGMRLFDGASRHGEPVLFAAAMSPLRGDVEVPALLRGLQTVKRPQSRTAARNEVDASSLRDRLAALAPAEREKALL

SEQ ID NO: 258 - protein, 97 aa, Artificial Sequence
  synthetic
DASGLTTQLTDTDRDRIRRGGLRTITAEYGMRLFDTASRHGNPILVAAPMDPVWDAEVPALLRSLHRPVARRAASTSDSSARWLAALAPAEREDALL

SEQ ID NO: 259 - protein, 96 aa, Artificial Sequence
  synthetic
YTGDLTAQLTGTDQDRIRCSGMRTITAEDGMRLFDTASHHGEPLLVPAVLDPTRDGEVPALLRSLRRPIARRAASADGGVQWLAALAPAEREKALL

SEQ ID NO: 260 - protein, 120 aa, Artificial Sequence
  synthetic
VVFAERMAECAAALSEFVDWDLFTVLDDPAVVDRVDVVQPASWAVMVSLAAVWQAAGVRPDAVIGHSQGEIAAACVAGAVSLRDAARIVTLRSQAIARGLAGRGAMASVALPAHEIELVD

SEQ ID NO: 261 - protein, 120 aa, Artificial Sequence
  synthetic
VVFAERMAECAAALSEFVDWDLFTVLDDPAVVDRVDVVQPASWAVMVSLAAVWQAAGVRPDAVIGHSQGEIAAACVAGAVSLRDAARIVTLRSQAIARGLAGRGAMASVALPAQDVELVD

SEQ ID NO: 262 - protein, 120 aa, Artificial Sequence
  synthetic
VVFAERMAECAAALSEFVDWDLFAVLDDPAVVDRVDVVQPASWAVMVSLAAVWQAAGVRPDAVIGHSQGEIAAACVAGAVSLRDAARIVTLRSQAIARGLAGRGAMASVALPAHEIELVD

SEQ ID NO: 263 - protein, 60 aa, Artificial Sequence
  synthetic
VVFAERMAECAAALSEFVDWDLFTVLDDPAVVDRVDVVQPASWAMMVSLAAVWQAAGVRP

SEQ ID NO: 264 - protein, 60 aa, Artificial Sequence
  synthetic
VVFAERMAECAAALSEFVDWDLFTVLDDPAVVDRVDVVQPASWAVMVSLAAVWQAAGVRP

SEQ ID NO: 265 - protein, 60 aa, Artificial Sequence
  synthetic
IVFAERMAECAAALREFVDWDLFTVLDDPAVVDRVDVVQPASWAMMVSLAAVWQAAGVRP

SEQ ID NO: 266 - protein, 60 aa, Artificial Sequence
  synthetic
TAQLTDTDRDRIRRGGLRAISAEHGMGLFDSASRHSEPVLVAAAMEPVRDAEVPALLRSL

SEQ ID NO: 267 - protein, 60 aa, Artificial Sequence
  synthetic
TAQLTDTDRDRIRRGGLRAISAEHGMGLFDSASRHSEPVLVAAPMEPVRDAEVPALLRSL

SEQ ID NO: 268 - protein, 60 aa, Artificial Sequence
  synthetic
TANLTDTDRDRIRRGGLRAISAEYGMGLFDSASRHSEPVLVAAAMEPVRDAEVPALLRSL

SEQ ID NO: 269 - protein, 240 aa, Artificial Sequence
  synthetic
SDAQAKGHQVLAVVRSSAVNQDGASNGLTAPNGPSQQRVIQAALSNAGLAAHEVDVVEAHGTGTTLGDPIEAQAVIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAPPAQPAEEAQPVETPVVASDVLPLVISAKTQPALTEHEDRLRAYLAASPGVDTRAVASTLAVT

SEQ ID NO: 270 - protein, 240 aa, Artificial Sequence
  synthetic
SDAQAKGHQVLAVVRSSAVNQDGASNGLTAPNGPSQQRVIQAALSNAGLAAHEVDVVEAHGTGTTLGDPIEAQAVIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAPPAQPAEEAQPVETPVVASDVLPLVISAKTQPALTEHEDRLRAYLAASPGADTRAVASTLAVT

SEQ ID NO: 271 - protein, 240 aa, Artificial Sequence
  synthetic
SDAQAKGHQVLAVVRSSAVNQDGASNGLSAPNGPSQQGVIRQALANAGLTTAEVDVVEAHGTGTTLGDPIEAQAVIATYGQDRERPLLLGSLKSNIGHAQAASGVSGVIKMVMALQHNTVPRTLHVDEPSRHVDWAAGAVELVRENQPWPGTDRPRRAGVSSFGVSGTNAHVILESAPPAQPAEEAQPVETPVVASDVLPLVISAKTQPALTEHEDRLRAYLAASPGVDTRAVASTLAVT

SEQ ID NO: 272 - protein, 120 aa, Artificial Sequence
  synthetic
QGECSLALVGGVTVMATPELFTEFSRQRGLASDGRCKAFADSADGTGWAEGVGVLLVERLSDAQAKGHQVLAVVRSSAVNQDGASNGLSAPNGPSQQGVIRQALANAGLTTAEVDVVEAH

SEQ ID NO: 273 - protein, 120 aa, Artificial Sequence
  synthetic
QGECSLALVGGVTVMATPELFTEFSRQRGLASDGRCKAFADSADGTGWAEGVGVLLVERLSDAQAKGHQVLAVVRSSAVNQDGASNGLTAPNGPSQQRVIQAALSNAGLAAHEVDVVEAH

SEQ ID NO: 274 - protein, 120 aa, Artificial Sequence
  synthetic
QGECSLALVGGVTVMATPQSFVEFSRQRGLASDGRCKAFADSADGTGWAEGVGVLLVERLSDAQAKGHQVLAVVRSSAVNQDGASNGLSAPNGPSQQGVIRQALANAGLTTAEVDVVEAH

SEQ ID NO: 275 - protein, 60 aa, Artificial Sequence
  synthetic
ASWAMMVSLAAVWQAAGVRPDAVIGHSQGEIAAACVAGAVSLRDAARIVTLRSQAIARGL

SEQ ID NO: 276 - protein, 60 aa, Artificial Sequence
  synthetic
ASWAMMVSLAAVWQAAGVRPDAVIGHSQGEIAAACVAGAVSMRDAARIVTLRSQAIARGL

SEQ ID NO: 277 - protein, 60 aa, Artificial Sequence
  synthetic
ASWAVMVSLAAVWQAAGVRPDAVIGHSQGEIAAACVAGAVSLRDAARIVTLRSQAIARGL

SEQ ID NO: 278 - protein, 120 aa, Artificial Sequence; identical to SEQ ID NO: 260
  synthetic

SEQ ID NO: 279 - protein, 120 aa, Artificial Sequence; identical to SEQ ID NO: 261
  synthetic

SEQ ID NO: 280 - protein, 120 aa, Artificial Sequence; identical to SEQ ID NO: 262
  synthetic

SEQ ID NO: 281 - protein, 60 aa, Artificial Sequence
  syntehtic
SDARRNGHQVLAVVRGSAVNQDGASNGLTAPNGPSQQRVIQAALSNAGLAAHEVDVVEAH

SEQ ID NO: 282 - protein, 60 aa, Artificial Sequence
  synthetic
SDARRNGHQVLAVVRGSAVNQDGASNGLTAPNGPSQQRVIRAALSNAGLSTAEVDVVEAH

SEQ ID NO: 283 - protein, 60 aa, Artificial Sequence
  synthetic
SDAQAKGHQVLAMLRSSAVNQDGASNGLTAPNGPSQQRVIQAALSNAGLAAHEVDVVEAH

SEQ ID NO: 284 - protein, 240 aa, Artificial Sequence
  synthetic
VFPGQGSQRAGMGEELAAAFPVFARIHQQVWDLLDVPDLDVNETGYAQPALFALQVALFGLLESWGVRPDAVVGHSVGELAAGYVSGLWSLEDACTLVSARARLMQALPAGGVMVAVPVSEDEARAVLGEGVEIAAVNGPSSVVLSGDEAAVLQAAEGLGKWTRLATSHAFHSARMEPMLEEFRTVAEGLTYRTPQVSMAAGDQVTTTEYWVRQVRDTVRFGEQVASYEDAVFVELGADR

SEQ ID NO: 285 - protein, 240 aa, Artificial Sequence
  synthetic
VFPGQGSQRAGMGEELAAAFPVFARIHQQVWDLLDVPDLDVNETGYAQPALFALQVALFGLLESWGVRPDAVVGHSVGELAAGYVSGLWSLEDACTLVSARARLMQALPAGGVMVAVPVSEDEARAVLGEGVEIAAVNGPSSVVLSGDEAAVLQAAEGLGKWTRLATSHAFHSARMEPMLEEFRAVAEGLTYRTPQVAMAAGDQVMTAEYWVRQVRDTVRFGEQVASFEDAVFVELGADR

SEQ ID NO: 286 - protein, 180 aa, Artificial Sequence
  synthetic
LLESWGVRPDAVVGHSVGELAAGYVSGLWSLEDACTLVSARARLMQALPAGGVMVAVPVSEDEARAVLGEGVEIAAVNGPSSVVLSGDEAAVLQAAEGLGKWTRLATSHAFHSARMEPMLEEFRTVAEGLTYRTPQVSMAAGDQVTTTEYWVRQVRDTVRFGEQVASYEDAVFVELGADR

SEQ ID NO: 287 - protein, 60 aa, Artificial Sequence
  synthetic
ERLSDAQAKGHQVLAVVRSSAVNQDGASNGLTAPNGPSQQGVIRQALANAGLTTAEVDVV

SEQ ID NO: 288 - protein, 60 aa, Artificial Sequence
  synthetic
ERLSDAQAKGHQVLAVVRSSAVNQDGASNGLTAPNGPSQQRVIQAALSNAGLAAHEVDVV

SEQ ID NO: 289 - protein, 60 aa, Artificial Sequence
  synthetic
ERLSDAQAKGHQVLAVVRSSAVNQDGASNGLSAPNGPSQQGVIRQALANAGLTTAEVDVV

SEQ ID NO: 290 - protein, 180 aa, Artificial Sequence
  synthetic
DLALVPTDTAERPLQSGEVRVDVRAAGLNFRDVVVALGMVDDKRLAGGEAAGVVLEVGPEVQDLAPGDRVFGLVGGGFGAVAIADRRMLGVIPDGWSFTTAASVPVVFATAYYGLVDLAGLSAGESVLIHAAAGGVGMAATQIARHLGARIYATASTGKQHVLREAGLEDARIGDSRTTG

SEQ ID NO: 291 - protein, 180 aa, Artificial Sequence
  synthetic
DLALVPTDTAERPLQSGEVRVDVRAAGLNFRDVVVALGMVDDKRLAGGEAAGVVLEVGPEVQDLAPGDRVFGLVGGGFGAVAIADRRMLGVIPDGWSFTTAASVPVVFATAYYGLVDLAGLSAGESVLIHAAAGGVGMAATQIARHLGARIYATASTGKQHILREAGLEDTHIADSRTLS

SEQ ID NO: 292 - protein, 180 aa, Artificial Sequence
  synthetic
DLALVPAETAERPLQSGEVRVDVRAAGLNFRDVLIALGTYPGEAVIGAEAAGVVLEVGPEVQDLAPGDRVFGLVGGGFGAVAIADRRMLGVIPDGWSFTTAASVPVVFATAYYGLVDLAGLSAGESVLIHAAAGGVGMAATQIARHLGARIYATASTGKQHVLREAGLEDARIGDSRTTG

SEQ ID NO: 293 - protein, 120 aa, Artificial Sequence
  synthetic
TAQLTDTDRDRIRRGGLRAISAEHGMGLFDSASRHSEPVLVAAPMEPVRDAEVPALLRSLHRPNVRRAALAGGAQWLAALAPEERAKALLKVVRDTAATVLGHADARTIPVTGAFRDLGI

SEQ ID NO: 294 - protein, 120 aa, Artificial Sequence
  synthetic
TAQLTDTDRDRIRRGGLRAISAEHGMGLFDSASRHSEPVLVAAPMEPVRDAEVPALLRSLHRPIARRAAAAGGARWLAALAPAEREKALLKLVCDSAATVLGHADTSTVSVAAVFRDLGV

SEQ ID NO: 295 - protein, 120 aa, Artificial Sequence
  synthetic
TAQLTDTDRDRIRRGGLRAISAEHGMRLFDNASRHSEPVLVAAPMEPVRDAEVPALLRSLHRPNVRRAALAGGAQWLAALAPEERAKALLKVVRDTAATVLGHADARTIPVTGAFRDLGI

SEQ ID NO: 296 - protein, 80 aa, Artificial Sequence
  synthetic
EEFRAVAEGLTYRTPQVAMAAGDQVMTAEYWVRQVRDTVRFGEQVASFEDAVFVELGADRSLARLVDGVAMLHGDHEAQA

SEQ ID NO: 297 - protein, 80 aa, Artificial Sequence
  synthetic
EEFRAVAEGLTYRTPQVAMAAGDQVMTAEYWVRQVRDTVRFGEQVASFEDAVFVELGADRSLARLVDGIAMLHGDHEAQA

SEQ ID NO: 298 - protein, 80 aa, Artificial Sequence
  synthetic
EEFRTVAEGLTYRTPQVSMAAGDQVTTTEYWVRQVRDTVRFGEQVASYEDAVFVELGADRSLARLVDGVAMLHGDHEAQA

SEQ ID NO: 299 - protein, 59 aa, Artificial Sequence
  synthetic
LLRSLHRPIARRAAAAGGARWLAALAPAEREKALLKLVCDSAAMVLGHADARSIPAAGA

SEQ ID NO: 300 - protein, 59 aa, Artificial Sequence
  synthetic
LLRSLHRPIARRAAAAGGARWLAALAPAEREKALLKLVCDSAATVLGHADTSTVSVAAV

SEQ ID NO: 301 - protein, 60 aa, Artificial Sequence
  synthetic
LLRSLRRPIARRAASADGGVQWLAALAPAEREKALLKLVCDSAAMVLGHADARSIPAAGA

SEQ ID NO: 302 - protein, 180 aa, Artificial Sequence
  synthetic
IGAFPVGYGAGFDREGYGATSGPSVLSGRVSYVFGLEGPAITMDTACSSSLVALHLAAQALRNGECSMALAGGVTVMATPEVFTEFARQRGLASDGRCKAFADSADGAGFSEGAGLLLVERLSDARRNGHQVLAVVRGSAVNQDGASNGFTAPNGPAQQRVIRQALANAGLTTAEVDVVE

SEQ ID NO: 303 - protein, 180 aa, Artificial Sequence
  synthetic
IGAFPVGYGAGFDREGYGATSGPSVLSGRVSYVFGLEGPAITMDTACSSSLVALHLAAQALRNGECSMALAGGVTVMATPEVFTEFARQRGLASDGRCKAFADSADGAGFSEGAGLLLVERLSDARRNGHQVLAVVRGSAVNQDGASNGLTAPNGPSQQRVIRAALSNAGLSTADVDVVE

SEQ ID NO: 304 - protein, 180 aa, Artificial Sequence
  synthetic
IGAFPVGYGAGAAREGYGATAAPNVLSGRLSYFFGLEGPAITMDTACSSSLVALHLAAQALRNGECSMALAGGVTVMATPEVFTEFARQRGLASDGRCKAFADSADGAGFSEGAGLLLVERLSDARRNGHQVLAVVRGSAVNQDGASNGFTAPNGPAQQRVIRQALANAGLTTAEVDVVE

SEQ ID NO: 305 - protein, 59 aa, Artificial Sequence; identical to SEQ ID NO: 299
  synthetic

SEQ ID NO: 306 - protein, 59 aa, Artificial Sequence; identical to SEQ ID NO: 300
  synthetic

SEQ ID NO: 307 - protein, 60 aa, Artificial Sequence; identical to SEQ ID NO: 301
  synthetic

SEQ ID NO: 308 - protein, 59 aa, Artificial Sequence; identical to SEQ ID NO: 299
  synthetic

SEQ ID NO: 309 - protein, 59 aa, Artificial Sequence; identical to SEQ ID NO: 300
  synthetic

SEQ ID NO: 310 - protein, 60 aa, Artificial Sequence; identical to SEQ ID NO: 301
  synthetic

SEQ ID NO: 311 - protein, 60 aa, Artificial Sequence
  synthetic
VTRSLFEHRAVLLGDDSVTGTGTAVSDPRVVFVFPGQGWQWLGMGSALRDSSIVFAERMA

SEQ ID NO: 312 - protein, 60 aa, Artificial Sequence
  syntehtic
VTRSLFEHRAVLLGDDSVTGTGTAVSDPRVVFVFPGQGWQWLGMGSALRTSSMVFAERMA

SEQ ID NO: 313 - protein, 58 aa, Artificial Sequence
  synthetic
VTRSVFEHRAVLLGDDTVTGTAVSDPRVVFVFPGQGWQWLGMGSALRDSSIVFAERMA

SEQ ID NO: 314 - protein, 240 aa, Artificial Sequence
  synthetic
LLESWGVRPDAVVGHSVGELAAGYVSGLWSLEDACTLVSARARLMQALPAGGVMVAVPVSEDEARAVLGEGVEIAAVNGPSSVVLSGDEAAVLQAAEGLGKWTRLATSHAFHSARMEPMLASGLTAQLTDTDRDRIRRGGLRAISAEHGMGLFDSASRHSEPVLVAAPMEPVRDAEVPALLRSLHRPIARRAAAAGGARWLAALAPAEREKALLKLVSDGAATVLGHADTSTIPATTAFK

SEQ ID NO: 315 - protein, 240 aa, Artificial Sequence
  synthetic
LLESWGVRPDAVVGHSVGELAAGYVSGLWSLEDACTLVSARARLMQALPAGGVMVAVPVSEDEARAVLGEGVEIAAVNGPSSVVLSGDEAAVLQAAEGLGKWTRLATSHAFHSARMEPMLASGLTAQLTDTDRDRIRRGGLRAISAEHGMGLFDSASRHSEPVLVAAPMEPVRDAEVPALLRSLHRPIARRAAAAGGARWLAALAPAEREKALLKLVCDSAATVLGHADTSTVSVAAVFR

SEQ ID NO: 316 - protein, 240 aa, Artificial Sequence
  synthetic
LLESWGVRPDAVIGHSVGELAAAYVSGVWSLEDACTLVSARARLMQALPAGGVMVAVPVSEDEARAVLGEGVEIAAVNGPSSVVLSGDEAAVLQAAEGLGKWTRLATSHAFHSARMEPMLASGLTAQLTDTDRDRIRRGGLRAISAEHGMGLFDSASRHSEPVLVAAPMEPVRDAEVPALLRSLHRPIARRAAAAGGARWLAALAPAEREKALLKLVSDGAATVLGHADTSTIPATTAFK

SEQ ID NO: 317 - protein, 60 aa, Artificial Sequence
  synthetic
DDGDATRMLTALAQAYVHGVTVDWPAILGTTTTRVLDLPTYAFQHQRYWLRSVDRAAADG

SEQ ID NO: 318 - protein, 60 aa, Artificial Sequence
  synthetic
DDGDATRMLTALAQAYVHGVTVDWPAILGTTTTRVLDLPTYAFQHQRYWLKSVDRAAADG

SEQ ID NO: 319 - protein, 60 aa, Artificial Sequence
  synthetic
DDGDATRMLTALAQAYVHGVTVDWPAILGTATTRVLDLPTYAFQHQRYWLRSVDRAAADG

SEQ ID NO: 320 - protein, 477 aa, Artificial Sequence
  synthetic
TAEAESATTPVRSEVSESAAVFDARSGVVPVVVSGRSRVVVREAAGRLAEVVEAGGVGLADVAVTMAGRSRFGYRAVVLARGEAELAGRLRALAGGDPDAGVVTGAVVDPETGSGGGGVVLVFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPT

SEQ ID NO: 321 - protein, 480 aa, Artificial Sequence
  synthetic
TAEAESATTPVRSEVSESAAVFDARSGVVPVVVSGRSRVVVREAAGRLAEVVEAGGVGLADVAVTMAGRSRFGYRAVVLARGEAELAGRLRALAGGDPDAGVVTGAVVDPETGSGGGGVVLVFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPTDAQ

SEQ ID NO: 322 - protein, 477 aa, Artificial Sequence
  synthetic
TAEAESATTPVRSEVSESAAVLDARSGVVPVVVSGRSRVVVREAAGRLAEVVEAGGVGLADVAVTMAGRSRFGYRAVVLARGEAELAGRLRALAGGDPDAGVVTGAVVDPETGSGGGGVVLVFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPT

SEQ ID NO: 323 - protein, 477 aa, Artificial Sequence; identical to SEQ ID NO: 320
  synthetic

SEQ ID NO: 324 - protein, 480 aa, Artificial Sequence; identical to SEQ ID NO: 321
  synthetic

SEQ ID NO: 325 - protein, 477 aa, Artificial Sequence; identical to SEQ ID NO: 322
  synthetic

SEQ ID NO: 326 - protein, 477 aa, Artificial Sequence; identical to SEQ ID NO: 320
  synthetic

SEQ ID NO: 327 - protein, 480 aa, Artificial Sequence; identical to SEQ ID NO: 321
  synthetic

SEQ ID NO: 328 - protein, 477 aa, Artificial Sequence; identical to SEQ ID NO: 322
  synthetic

SEQ ID NO: 329 - protein, 660 aa, Artificial Sequence
  synthetic
AGVMPQEYGPRLAEGAEGSDGYLLTGTSGSVVSGRVAYTLGLEGPAVTVDTACSSSLVALHLAVQALRGGECDMALAGGVTVMAGPGMFVEFSRQRGLAADGRCKAFADGADGTAWAEGAGVVLVERLSDARRLGHPVLAVVCGSAVNQDGASNGLTAPSGPSQERVIRQALGNARLTVAAGVMPQEYGPRLAEGAEGSDGYLLTGTSGSVVSGRVAYTLGLEGPAVTVDTACSSSLVALHLAVQALRGGECDMALAGGVTVMAGPGMFVEFSRQRGLAADGRCKAFADGADGTAWAEGAGVVLVERLSDARRLGHPVLAVVCGSAVNQDGASNGLTAPSGPSQERVIRQALGNARLTVADVDVVEAHGTGTRLGDPIEAQALLGTYGRDRDGGRPVWLGSLKSNIGHAQAAAGVAGVIKMVLAMRYGWLPRTLHVDEPSRHVDWSAGGVWLLTEAREWPGVDRPRRAAVSAFGVSGTNAHLILEAPDTAEAESATTPVRSEVSESAAVFDARSGVVPVVVSGRSRVVVREAAGRLAEVVEAGGVGLADVAVTMAGRSRFGYRAVVLARGEAELAGRLRALAGGDPDAGVVTGAVVDPETGSGGGGVVLVFPGQGTQWVGMGAGLLGSSEVFAASMRECARALSVHVGWDLLEVVSGGAG

SEQ ID NO: 330 - protein, 660 aa, Artificial Sequence
  synthetic
AGVMPQEYGPRLAEGAEGSDGYLLTGTSGSVVSGRVAYTLGLEGPAVTVDTACSSSLVALHLAVQALRGGECDMALAGGVTVMAGPGMFVEFSRQRGLAADGRCKAFADGADGTAWAEGAGVVLLQRLSDARREGRPVLAVVCGSAVNQDGASNGLTAPSGPSQERVIRQALGNARLTVAAGVMPQEYGPRLAEGAEGSDGYLLTGTSGSVVSGRVAYTLGLEGPAVTVDTACSSSLVALHLAVQALRGGECDMALAGGVTVMAGPGMFVEFSRQRGLAADGRCKAFADGADGTAWAEGAGVVLLQRLSDARREGRPVLAVVCGSAVNQDGASNGLTAPSGPSQERVIRQALGNARLTVADVDVVEAHGTGTRLGDPIEAQALLGTYGRDRDGGRPVWLGSLKSNIGHAQAAAGVAGVIKMVLAMRYGWLPRTLHVDEPSRHVDWSAGGVWLLTEAREWPGVDRPRRAAVSAFGVSGTNAHLILEAPDTAEAESATTPVRSEVSESAAVFDARSGVVPVVVSGRSRVVVREAAGRLAEVVEAGGVGLADVAVTMAGRSRFGYRAVVLARGEAELAGRLRALAGGDPDAGVVTGAVVDPETGSGGGGVVLVFPGQGTQWVGMGAGLLGSSEVFAASMRECARALSVHVEWDLLEVVSGGAG

SEQ ID NO: 331 - protein, 658 aa, Artificial Sequence
  synthetic
AGVMYHDYGTGQTSATDTSGYSGTGTSGSVVSGRVAYTLGLEGPAVTVDTACSSSLVALHLAVQALRGGECDMALAGGVTVMAGPGMFVEFSRQRGLAADGRCKAFADGADGTAWAEGAGVVLVERLSDARRLGHPVLAVVCGSAVNQDGASNGLTAPSGPSQERVIRQALANARLTVAAGVMYHDYGTGQTSATDTSGYSGTGTSGSVVSGRVAYTLGLEGPAVTVDTACSSSLVALHLAVQALRGGECDMALAGGVTVMAGPGMFVEFSRQRGLAADGRCKAFADGADGTAWAEGAGVVLVERLSDARRLGHPVLAVVCGSAVNQDGASNGLTAPSGPSQERVIRQALANARLTVADVDVVEAHGTGTRLGDPIEAQALLGTYGRDRDGGRPVWLGSLKSNIGHAQAAAGVAGVIKMVLAMRYGWLPRTLHVDEPSRHVDWSAGGVWLLTEAREWPGVDRPRRAAVSAFGVSGTNAHLILEAPDTAEAESATTPVRSEVSESAAVFDARSGVVPVVVSGRSRVVVREAAGRLAEVVEAGGVGLADVAVTMAGRSRFGYRAVVLARGEAELAGRLRALAGGDPDAGVVTGAVVDPETGSGGGGVVLVFPGQGTQWVGMGAGLLGSSEVFAASMRECARALSVHVGWDLLEVVSGGAG

SEQ ID NO: 332 - protein, 477 aa, Artificial Sequence; identical to SEQ ID NO: 320
  synthetic

SEQ ID NO: 333 - protein, 480 aa, Artificial Sequence; identical to SEQ ID NO: 321
  synthetic

SEQ ID NO: 334 - protein, 477 aa, Artificial Sequence; identical to SEQ ID NO: 322
  synthetic

SEQ ID NO: 335 - protein, 360 aa, Artificial Sequence
  synthetic
VFPGQGTQWVGMGAGLLGSSEVFAASMRECARALSVHVEWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPTDAQN

SEQ ID NO: 336 - protein, 356 aa, Artificial Sequence
  synthetic
VFPGQGTQWVGMGAGLLGSSEVFAASMRECARALSVHVEWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPT

SEQ ID NO: 337 - protein, 360 aa, Artificial Sequence
  synthetic
VFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPTDAQN

SEQ ID NO: 338 - protein, 174 aa, Artificial Sequence
  synthetic
AGRGAMAAVPLPAGEVEAGLAKWPGVQVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQ

SEQ ID NO: 339 - protein, 174 aa, Artificial Sequence
  synthetic
AGRGAMAAVPLPAGEVEAGLAKWPGVQVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEQGHRRFIEVSAHPVLVHAIEQTAEAADRSVHATGTLRRQ

SEQ ID NO: 340 - protein, 174 aa, Artificial Sequence
  synthetic
AGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQ

SEQ ID NO: 341 - protein, 174 aa, Artificial Sequence; identical to SEQ ID NO: 338
  synthetic

SEQ ID NO: 342 - protein, 174 aa, Artificial Sequence; identical to SEQ ID NO: 339
  synthetic

SEQ ID NO: 343 - protein, 174 aa, Artificial Sequence; identical to SEQ ID NO: 340
  synthetic

SEQ ID NO: 344 - protein, 420 aa, Artificial Sequence
  synthetic
AGAAGGAGAAGGAGGGGVVLVFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPTDAWRYRVTWKALTEESTPASSPSGHWLLVTPPTPEGRTLGDRAA

SEQ ID NO: 345 - protein, 399 aa, Artificial Sequence
  synthetic
AGAAGGAGAAGGAGGGGVVLVFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTIDGGGGDDATQEKESGPLTRELRGLPSSQKQLGFLL

SEQ ID NO: 346 - protein, 411 aa, Artificial Sequence
  synthetic
ETGSGGGGVVLVFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPTDAWRYRVTWKALTEESTPASSPSGHWLLVTPPTPEGRTLGDRAA

SEQ ID NO: 347 - protein, 180 aa, Artificial Sequence
  synthetic
AGRGAMAAVPLPAGEVEAGLAKWPGVQVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHR

SEQ ID NO: 348 - protein, 180 aa, Artificial Sequence
  synthetic
AGRGAMAAVPLPAGEVEAGLAKWPGVQVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEQGHRRFIEVSAHPVLVHAIEQTAEAADRSVHATGTLRRQDDSPHR

SEQ ID NO: 349 - protein, 180 aa, Artificial Sequence
  synthetic
AGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHR

The invention claimed is:

1. A method for producing a hybrid polyketide synthase (PKS) gene of a type 1 modular PKS in which one or more modules are deleted or inserted which comprises joining three or more sections of DNA encoding PKS genes or parts thereof no pair of which is contiguous in nature and creating two or more junctions between said sections of DNA (a) within DNA encoding a ketosynthase (KS) domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 as well as amino acids 203-346 of SEQ ID NO 38; or (b) within DNA encoding an acyl-transferase (AT) domain so that two AT domains $AT_n$ and $AT_{n+1}$ are joined at a position in a region within those residues of the amino acid sequences of said $AT_n$ and $AT_{n+1}$ that are aligned with amino acids 5-246 of SEQ ID NO 85 or amino acids 5-269 of SEQ ID NO 86 or (c) in DNA encoding the inter-domain region before the acyl carrier protein (ACP) domain so that two pre-ACP domain regions pre-$ACP_n$ and pre-$ACP_{n+1}$ are joined at a position in a region within those residues of the amino acid sequences of said pre-$ACP_n$ and pre-$ACP_{n+1}$ domains that are aligned with amino acids 184-268 of SEQ ID NO 39, amino acids 184-269 of SEQ ID NO 40 and amino acids 184-270 of SEQ ID NO 41.

2. A method according to claim 1 in which a junction is created (a) within DNA encoding a KS domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 as well as amino acids 203-346 of SEQ ID NO 38.

3. A method according to claim 1 in which a junction is created (b) within DNA encoding an AT domain so that two AT domains $AT_n$ and $AT_{n+1}$ are joined at a position in a region within those residues of the amino acid sequences of said $AT_n$ and $AT_{n+1}$ that are aligned with amino acids 5-246 of SEQ ID NO 85 or amino acids 5-269 of SEQ ID NO 86.

4. A method according to claim 3 wherein $AT_n$ and $AT_{n+1}$ have the same specificity.

5. A method according to claim 1 in which a junction is created (c) in the DNA encoding an inter-domain region before the ACP domain so that two pre-ACP domain regions pre-$ACP_n$ and pre-$ACP_{n+1}$ are joined at a position in a region within those residues of the amino acid sequences of said pre-$ACP_n$ and pre-$ACP_{n+1}$ domains that are aligned with amino acids 184-268 of SEQ ID NO 39, amino acids 184-269 of SEQ ID NO 40 and amino acids 184-270 of SEQ ID NO 41.

6. A method according to claim 1 which involves joining three sections of DNA encoding PKS genes or parts thereof no pair of which is contiguous in nature thereby to create two junctions.

7. A method according to claim 1 wherein the hybrid PKS gene is a PKS gene in which one or more modules have been deleted.

8. A method according to claim 1 wherein the hybrid PKS gene is a PKS gene in which one or more modules have been inserted.

9. A method according to claim 1 which is performed ex vivo.

10. A method according to claim 1 which is performed in a non-bacterial host cell.

11. A method according to claim 1, wherein the hybrid PKS gene of a type 1 modular PKS can lead to production of a polyketide (PK).

12. A process for producing a polyketide which comprises culturing a polyketide producing cell comprising one or more genes of a hybrid PKS gene of a type 1 modular produced by the method according to claim 1.

13. A method for producing a hybrid rapamycin synthase gene in which one or more modules are deleted or inserted which comprises joining two sections of DNA encoding a rapamycin synthase gene or part thereof which are non-contiguous in nature and creating the junction between said sections of DNA (a) within DNA encoding a ketosynthase (KS) domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 as well as amino acids 203-346 of SEQ ID NO 38; or (b) within DNA encoding an acyltransferase (AT) domain so that two AT domains $AT_n$ and $AT_{n+1}$ are joined at a position in a region within those residues of the amino acid sequences of said $AT_n$ and $AT_{n+1}$ that are aligned with amino acids 5-246 of SEQ ID NO 85 or amino acids 5-269 of SEQ ID NO 86; or (c) in DNA encoding the inter-domain region before the acyl carrier protein (ACP) domain so that two pre-ACP domain regions pre-$ACP_n$ and pre-$ACP_{n+1}$ are joined at a position in a region within those residues of the amino acid sequences of said pre-$ACP_n$ and pre-$ACP_{n+1}$ domains that are aligned with amino acids 184-268 of SEQ ID NO 39, amino acids 184-269 of SEQ ID NO 40 and amino acids 184-270 of SEQ ID NO 41.

14. A method according to claim 13 in which a junction is created (a) within DNA encoding a KS domain so that two KS domains $KS_n$ and $KS_{n+1}$ are joined at a position in a region within those residues of the amino acid sequences of said $KS_n$ and $KS_{n+1}$ that are aligned with amino acids 199-342 of SEQ ID NO 37 as well as amino acids 203-346 of SEQ ID NO 38.

15. A method according to claim 13 in which a junction is created (b) within DNA encoding an AT domain so that two AT domains $AT_n$ and $AT_{n+1}$ are joined at a position in a region within those residues of the amino acid sequences of said $AT_n$ and $AT_{n+1}$ that are aligned with amino acids 5-246 of SEQ ID NO 85 or amino acids 5-269 of SEQ ID NO 86.

16. A method according to claim 15 wherein $AT_n$ and $AT_{n+1}$ have the same specificity.

17. A method according to claim 13 in which a junction is created (c) in the DNA encoding an inter-domain region before the ACP domain so that two pre-ACP domain regions pre-$ACP_n$ and pre-$ACP_{n+1}$ are joined at a position in a region within those residues of the amino acid sequences of said pre-$ACP_n$ and pre-$ACP_{n+1}$ domains that are aligned with amino acids 184-268 of SEQ ID NO 39, amino acids 184-269 of SEQ ID NO 40 and amino acids 184-270 of SEQ ID NO 41.

18. A method according to claim 13 which involves joining three sections of DNA encoding rapamycin synthase genes or parts thereof no pair of which is contiguous in nature thereby to create two junctions.

19. A method according to claim 13 wherein the hybrid rapamycin synthase gene is a rapamycin synthase gene in which one or more modules have been deleted.

20. A method according to claim 13 wherein the hybrid rapamycin synthase gene is a rapamycin synthase gene in which one or more modules have been inserted.

21. A method according to claim 13 which is performed ex vivo.

22. A method according to claim 13 which is performed in a non-bacterial host cell.

23. A method according to claim 13, wherein the hybrid rapamycin synthase gene can lead to production of a polyketide (PK).

24. A process for producing a polyketide which comprises culturing a polyketide producing cell comprising one or more genes of a hybrid rapamycin synthase gene produced by the method according to claim 13.

\* \* \* \* \*